US007838636B1

(12) United States Patent
Ruben et al.

(10) Patent No.: US 7,838,636 B1
(45) Date of Patent: Nov. 23, 2010

(54) ANTIBODIES TO HWHGU54 POLYPEPTIDES

(75) Inventors: Steven M. Ruben, Brookeville, MD (US); Craig A. Rosen, Laytonsville, MD (US); Ying-Fei Wei, Berkeley, CA (US)

(73) Assignee: Human Genome Sciences, Inc., Rockville, MD (US)

( * ) Notice: Subject to any disclaimer, the term of this patent is extended or adjusted under 35 U.S.C. 154(b) by 348 days.

(21) Appl. No.: 11/760,578

(22) Filed: Jun. 8, 2007

Related U.S. Application Data

(63) Continuation of application No. 10/886,642, filed on Jul. 9, 2004, now abandoned, which is a continuation of application No. 10/050,873, filed on Jan. 18, 2002, now abandoned, said application No. 10/050,873 is a continuation-in-part of application No. 09/461,325, filed on Dec. 14, 1999, now Pat. No. 6,475,753, which is a continuation-in-part of application No. PCT/US99/13418, filed on Jun. 15, 1999.

(60) Provisional application No. 60/263,681, filed on Jan. 24, 2001, provisional application No. 60/263,230, filed on Jan. 23, 2001, provisional application No. 60/090,113, filed on Jun. 22, 1998, provisional application No. 60/090,112, filed on Jun. 22, 1998, provisional application No. 60/089,510, filed on Jun. 16, 1998, provisional application No. 60/089,509, filed on Jun. 16, 1998, provisional application No. 60/089,508, filed on Jun. 16, 1998, provisional application No. 60/089,507, filed on Jun. 16, 1998.

(51) Int. Cl.
*C07K 16/40* (2006.01)
*C12P 21/08* (2006.01)
*C12P 21/06* (2006.01)
*C12N 15/09* (2006.01)

(52) U.S. Cl. .............. 530/387.1; 530/387.3; 530/388.1; 530/388.15; 435/69.1; 435/320.1

(58) Field of Classification Search ........................ None
See application file for complete search history.

(56) References Cited

U.S. PATENT DOCUMENTS

| | | | |
|---|---|---|---|
| 5,011,912 A | 4/1991 | Hopp et al. | |
| 5,194,596 A | 3/1993 | Tischer et al. | |
| 5,350,836 A | 9/1994 | Kopchick et al. | |
| 5,534,409 A | 7/1996 | Groner et al. | |
| 5,536,637 A | 7/1996 | Jacobs | |
| 6,600,019 B2 * | 7/2003 | Prayaga et al. | 530/350 |
| 7,368,531 B2 | 5/2008 | Rosen et al. | |
| 7,411,051 B2 | 8/2008 | Rosen et al. | |
| 2007/0224663 A1 | 9/2007 | Rosen et al. | |

FOREIGN PATENT DOCUMENTS

| | | |
|---|---|---|
| WO | WO-91/04328 | 4/1991 |
| WO | WO-99/66041 | 12/1999 |
| WO | WO0146443 * | 6/2001 |

OTHER PUBLICATIONS

Wells, Biochemistry, 1990, vol. 29, pp. 8509-8517.*
Lazar et al Molecular Cell. Biol., 1988., vol. 8, pp. 1247-1252.*
Crandall et al, Journal of Immunology, 2006, vol. 177, pp. 7930-7942.*
Jacobs et al., "A genetic selection for isolating cDNAs encoding secreted proteins," *Gene*, 198:289-296 (1997).
Anisowicz et al., "A novel protease homolog differentially expressed in breast and ovarian cancer," *Molecular Medicine*, 2(5):624-636 (Sep. 1996).
Clark et al., "The potential role for prolactin-inducible protein (PIP) as a marker of human breast cancer micrometastasis," *British Journal of Cancer*, 81(6):1002-1008 (May 1999).
desJardins et al, "Prediction of enzyme classification from protein sequence without the use of sequnce similarity," *American Association for Artificial Intelligence*, pp. 92-99 (1997).
Everett et al., "Pendred Syndrome is Caused by Mutations in a Putative Sulphate Transporter Gene (PDS)," *Nature Genetics* 17:411-422 (Dec. 1997).
Ferrari et al., "Prospective analysis of prostate-specific markers in pelvic lymph nodes of patients with high-risk prostate cancer," *Journal of the National Cancer Institute*, 89:1498-1504 (Oct. 15, 1997).
Gygi et al., "Correlation between protein and mRNA abundance in yeast," *Molecular and Cellular Biology*, 19(3):1720-1730 (Mar. 1999).
Hammond et al., "Issues and Barriers to Development of Clinically Useful Tumor Markers: A Development Pathway Proposal," *Semin. Oncol.* 29(3):213-221 (Jun. 2002).
Haynes et al., "Proteome analysis: biological assay or data archive?" *Electrophoresis*, 19:1862-1871 (1998).
Holm, L., "Unification of protein families," *Current Opinion in Structural Biology*, 8:372-379 (1998).
Kaufman et al., "Transgenic analysis of a 100-kb human B-globulin cluster-containing DNA fragment propagated as a bacterial artificial chromosome," *Blood* 94(9):3178-3184 (Nov. 1, 1999).
Maida et al., "Ovarian endometrioid adenocarcinoma with ectopic production of alpha-fetoprotein," *Gynecol. Oncol.* 71(1):133-136 (Oct. 1998) (abstract only).
Ngo et al., "Computational Complexity, Protein Structure Prediction, and the Levinthal Paradox," in Merz and Le Grand (Eds.), The Protein Folding Problem and Tertiary Structure Prediction, Birkhauser Boston, pp. 491-495 (1994).
Palù et al., "In pursuit of new developments for gene therapy of human diseases," *J. Biotech.*, 68:1-13 (1999).
Pennica et al., "*WISP* genes are members of the connective tissue growth factor family that are up-regulated in Wnt-1-transformed cells and aberrantly expressed in human colon tumors," *Proc. Natl. Acad. Sci. USA*, 95:14717-14722 (Dec. 1998).

(Continued)

*Primary Examiner*—Bridget E Bunner
*Assistant Examiner*—Fozia M Hamud

(57) ABSTRACT

The present invention relates to novel human secreted proteins and isolated nucleic acids containing the coding regions of the genes encoding such proteins. Also provided are vectors, host cells, antibodies, and recombinant methods for producing human secreted proteins. The invention further relates to diagnostic and therapeutic methods useful for diagnosing and treating diseases, disorders, and/or conditions related to these novel human secreted proteins.

17 Claims, 4 Drawing Sheets

OTHER PUBLICATIONS

Phillips, A.J., "The challenge of gene therapy and DNA delivery," *J. Pharm. Pharmacol.*, 53:1169-1174 (May 1, 2001).

Scott et al., "The Pendred Syndrome Gene Encodes a Chloride-iodide Transport Protein," *Nature Genetics* 21:440-443 (Apr. 1999).

Seffernick et al., "Melamine Deaminase and Atrazine Chlorohydrolase: 98 Percent Identical but Functionally Different," *J. Bacteriology*, 183(8):2405-2410 (Apr. 2001).

Vukicevic et al., "Induction of nephrogenic mesenchyme by osteogenic protein 1 (bone morphogenetic protein 7)," *PNAS USA* 93:9021-9026 (Aug. 1996).

Wang et al., "Rapid analysis of gene expression (RAGE) facilitates universal expression profiling," *Nucl. Acids Res.*, 27(23):4609-4618 (1999).

Wells, J.A., "Additivity of Mutational Effects in Proteins," *Biochemistry*, 29(37):8509-8517 (1990).

Witkowski et al., "Conversion of Beta-Ketoacyl Synthase to a Malonyl Decarboxylase by Replacement of the Active-Site Cysteine with Glutamine," *Biochemistry* 38:11643-11650 (1999).

Irving et al., "Phylogeny of the Serpin Superfamily: Implications of Patterns of Amino Acid Conservation for Structure and Function", Genome Res., 10:1845-1864, 2000.

Patel et al., "KIf4 and corticosteroids activate an overlapping set of transcriptional targets to accelerate in utero epidermal barrier acquisition", PNAS, vol. 103, No. 49, 18668-18673, Dec. 5, 2006.

Cheng, S.Y., "Thyroxine-binding globulin precursor (T4-binding globulin)," Swiss-Prot Accession No. P05543, 1996.

Arakawa, et al., "Angiotensinogen precursor," Swiss-Prot Accession No. P01019, 1991.

Bollen, et al., "Alpha-1-Antitrypsin Precursor (Alpha-1 Protease Inhibitor) (Alpha-1-Antiproteinase)," Swiss-Prot Accession No. P01009, 1996.

Caminos, et al., "Serine (or cysteine) proteinase inhibitor, clade A (alpha-1 antiproteinase, antitrypsin), member 12 precursor [*Homo sapiens*]," Accession NP_776249, 2009.

Rao, et al., "α1-Antitrypsin Is Degraded and Non-Functional in Chronic Wounds But Intact and Functional in Acute Wounds: The Inhibitor Protects Fibronectin from Degradation by Chronic Wound Fluid Enzymes", The Journal of Investigative Dermatology, vol. 105, No. 4, 572-578, 1995.

\* cited by examiner

```
  1 GGCACGAGGT CCCCGACGCG CCCCGCCCAA CCCCTACGAT GAAGAGGGCG  50
  1                                                   M  K  R  A   4

51 TCCGCTGGAG GGAGCCGGCT GCTGGCATGG GTGCTGTGGC TGCAGGCCTG 100
  5 S  A  G  G   S  R  L   L  A  W   V  L  W   L  Q  A  W  21

101 GCAGGTGGCA GCCCCATGCC CAGGTGCCTG CGTATGCTAC AATGAGCCCA 150
 22 Q  V  A   A  P  C  P   G  A  C   V  C  Y   N  E  P  K 38

151 AGGTGACGAC AAGCTGCCCC CAGCAGGGCC TGCAGGCTGT GCCCGTGGGC 200
 39 V  T  T   S  C  P   Q  Q  G  L   Q  A  V   P  V  G  54

201 ATCCCTGCTG CCAGCCAGCG CATCTTCCTG CACGGCAACC GCATCTCGCA 250
 55 I  P  A  A   S  Q  R   I  F  L   H  G  N  R   I  S  H 71

251 TGTGCCAGCT GCCAGCTTCC GTGCCTGCCG CAACCTCACC ATCCTGTGGC 300
 72 V  P  A   A  S  F  R   A  C  R   N  L  T   I  L  W  L 88

301 TGCACTCGAA TGTGCTGGCC CGAATTGATG CGGCTGCCTT CACTGGCCTG 350
 89 H  S  N   V  L  A   R  I  D  A   A  A  F   T  G  L    104

351 GCCCTCCTGG AGCAGCTGGA CCTCAGCGAT AATGCACAGC TCCGGTCTGT 400
105 A  L  L  E   Q  L  D   L  S  D   N  A  Q   L  R  S  V 121

401 GGACCCTGCC ACATTCCACG GCCTGGGCCG CCTACACACG CTGCACCTGG 450
122 D  P  A   T  F  H  G   L  G  R   L  H  T   L  H  L  D 138

451 ACCGCTGCGG CCTGCAGGAG CTGGGCCCGG GGCTGTTCCG CGGCCTGGCT 500
139 R  C  G   L  Q  E   L  G  P  G   L  F  R   G  L  A    154

501 GCCCTGCAGT ACCTCTACCT GCAGGACAAC GCGCTGCAGG CACTGCCTGA 550
155 A  L  Q  Y   L  Y  L   Q  D  N   A  L  Q  A   L  P  D 171

551 TGACACCTTC CGCGACCTGG GCAACCTCAC ACACCTCTTC CTGCACGGCA 600
172 D  T  F   R  D  L  G   N  L  T   H  L  F   L  H  G  N 188
```

FIG. 1A

```
601 ACCGCATCTC CAGCGTGCCC GAGCGCGCCT TCCGTGGGCT GCACAGCCTC 650
189  R  I  S   S  V  P    E  R  A    F  R  G     L  H  S  L  204

651 GACCGTCTCC TACTGCACCA GAACCGCGTG GCCCATGTGC ACCCGCATGC 700
205 D  R  L    L  H  Q    N  R  V    A  H  V    H  P  H  A 221

701 CTTCCGTGAC CTTGGCCGCC TCATGACACT CTATCTGTTT GCCAACAATC 750
222 F  R  D    L  G  R    L  M  T    L  Y  L  F  A  N  N  L 238

751 TATCAGCGCT GCCCACTGAG GCCCTGGCCC CCCTGCGTGC CCTGCAGTAC 800
239  S  A  L    P  T  E    A  L  A  P    L  R  A   L  Q  Y   254

801 CTGAGGCTCA ACGACAACCC CTGGGTGTGT GACTGCCGGG CACGCCCACT 850
255 L  R  L  N   D  N  P    W  V  C    D  C  R   A  R  P  L 271

851 CTGGGCCTGG CTGCAGAAGT TCCGCGGCTC CTCCTCCGAG GTGCCCTGCA 900
272 W  A  W    L  Q  K  F   R  G  S    S  S  E     V  P  C  S 288

901 GCCTCCCGCA ACGCCTGGCT GGCCGTGACC TCAAACGCCT AGCTGCCAAT 950
289  L  P  Q    R  L  A    G  R  D   L  K  R  L    A  A  N  304

951 GACCTGCAGG GCTGCGCTGT GGCCACCGGC CCTTACCATC CCATCTGGAC 1000
305 D  L  Q  G    C  A  V    A  T  G     P  Y  H  P   I  W  T 321

1001 CGGCAGGGCC ACCGATGAGG AGCCGCTGGG GCTTCCCAAG TGCTGCCAGC 1050
322  G  R  A    T  D  E  E     P  L  G    L  P  K    C  C  Q  P 338

1051 CAGATGCCGC TGACAAGGCC TCAGTACTGG AGCCTGGAAG ACCAGCTTCG 1100
339  D  A  A    D  K  A    S  V  L  E    P  G  R    P  A  S   354

1101 GCAGGCAATG CGCTGAAGGG ACGCGTGCCG CCCGGTGACA GCCCGCCGGG 1150
355 A  G  N    A  L  K  G    R  V  P    P  G  D  S     P  P  G 371

1151 CAACGGCTCT GGCCCACGGC ACATCAATGA CTCACCCTTT GGGACTCTGC 1200
372  N  G  S    G  P  R  H    I  N  D    S  P  F     G  T  L  P 388
```

FIG. 1B

```
1201 CTGGCTCTGC TGAGCCCCCG GCTCACTGCA GTGCGGCCCG AGGGCTCCGA 1250
 389   G  S  A   E  P  P   A  H  C   S  A  A  R   G  L  R   404

1251 GCCACCAGGT TCCCCACTTC GGGCCCTCGC CGGAGGCCAG GCTGTTCACG 1300
 405 A  T  R  F   P  T  S   G  P  R   R  P  G   C  S  R   421

1301 CAAGAACCGC ACCCGCAGCC ACTGCCGTCT GGGCCAGGCA GGCAGCGGGG 1350
 422  K  N  R   T  R  S   H  C  R  L   G  Q  A   G  S  G  G 438

1351 GTGGCGGGAC TGGTGACTCA GAAGGCTCAG GTGCCCTACC CAGCCTCACC 1400
 439   G  G  T   G  D  S   E  G  S  G   A  L  P   S  L  T   454

1401 TGCAGCCTCA CCCCCCTGGG CCTGGCGCTG GTGCTGTGGA CAGTGCTTGG 1450
 455 C  S  L  T   P  L  G   L  A  L   V  L  W  T   V  L  G  471

1451 GCCCTGCTGA CCCCCAGCGG ACACAAGAGC GTGCTCAGCA GCCAGGTGTG 1500
 472 P  C  *
                                                             473

1501 TGTACATACG GGGTCTCTCT CCACGCCGCC AAGCCAGCCG GCGGCCGAC 1550

1551 CCGTGGGGCA GGCCAGGCCA GGTCCTCCCT GATGGACGCC TGCCGCCCGC 1600

1601 CACCCCCATC TCCACCCCAT CATGTTTACA GGGTTCGGCG GCAGCGTTTG 1650

1651 TTCCAGAACG CCGCCTCCCA CCCAGATCGC GGTATATAGA GATATGCATT 1700

1701 TTATTTTACT TGTGTAAAAA TATCGGACGA CGTGGAATAA AGAGCTCTTT 1750

1751 TCTTAAAAAA AAAAAAAAA AACTCGA 1777
```

FIG. 1C ated Jun. 8, 2007), and is hereby incorporated by reference in its entirety herein.

ANTIBODIES TO HWHGU54 POLYPEPTIDES

CROSS-REFERENCE TO RELATED APPLICATIONS

This application is a continuation of U.S. application Ser. No. 10/886,642, filed Jul. 9, 2004, now abandoned, which is a continuation of U.S. application Ser. No. 10/050,873, filed Jan. 18, 2002, now abandoned which claims benefit under 35 U.S.C. §119(e) of U.S. Provisional Application Nos. 60/263, 230, filed on Jan. 23, 2001, and 60/263,681, filed on Jan. 24, 2001; said U.S. application Ser. No. 10/050,873 is also a continuation-in-part of U.S. patent application Ser. No. 09/461,325, filed on Dec. 14, 1999, now U.S. Pat. No. 6,475, 753, which is a continuation-in-part of International Patent Application No: PCT/US99/13418, filed on Jun. 15, 1999, which claims benefit under 35 U.S.C. §119(e) of U.S. Provisional Application Nos. 60/089,507, 60/089,508, 60/089,509, 60/089,510, each of which was filed on Jun. 16, 1998, and 60/090,112 and 60/090,113, each of which was filed on Jun. 22, 1998, all of which are hereby incorporated by reference herein in their entirety.

STATEMENT UNDER 37 C.F.R. §1.77(B)(5)

This application refers to a "Sequence Listing" listed below, which is provided as a text document. The document is entitled "PZ029P2C2_SeqListing.txt" (588,310) bytes, created Jun. 8, 2007), and is hereby incorporated by reference in its entirety herein.

FIELD OF THE INVENTION

The present invention relates to novel proteins. More specifically, isolated nucleic acid molecules are provided encoding novel polypeptides. Novel polypeptides and antibodies that bind to these polypeptides are provided. Also provided are vectors, host cells, and recombinant and synthetic methods for producing human polynucleotides and/or polypeptides, and antibodies. The invention further relates to diagnostic and therapeutic methods useful for diagnosing, treating, preventing and/or prognosing disorders related to these novel polypeptides. The invention further relates to screening methods for identifying agonists and antagonists of polynucleotides and polypeptides of the invention. The present invention further relates to methods and/or compositions for inhibiting or enhancing the production and function of the polypeptides of the present invention.

BACKGROUND OF THE INVENTION

Unlike bacterium, which exist as a single compartment surrounded by a membrane, human cells and other eukaryotes are subdivided by membranes into many functionally distinct compartments. Each membrane-bounded compartment, or organelle, contains different proteins essential for the function of the organelle. The cell uses "sorting signals," which are amino acid motifs located within the protein, to target proteins to particular cellular organelles.

One type of sorting signal, called a signal sequence, a signal peptide, or a leader sequence, directs a class of proteins to an organelle called the endoplasmic reticulum (ER). The ER separates the membrane-bounded proteins from all other types of proteins. Once localized to the ER, both groups of proteins can be further directed to another organelle called the Golgi apparatus. Here, the Golgi distributes the proteins to vesicles, including secretory vesicles, the cell membrane, lysosomes, and the other organelles.

Proteins targeted to the ER by a signal sequence can be released into the extracellular space as a secreted protein. For example, vesicles containing secreted proteins can fuse with the cell membrane and release their contents into the extracellular space—a process called exocytosis. Exocytosis can occur constitutively or after receipt of a triggering signal. In the latter case, the proteins are stored in secretory vesicles (or secretory granules) until exocytosis is triggered. Similarly, proteins residing on the cell membrane can also be secreted into the extracellular space by proteolytic cleavage of a "linker" holding the protein to the membrane.

Thus there exists a clear need for identifying and using novel secreted polynucleotides and polypeptides. Identification and sequencing of human genes is a major goal of modern scientific research. For example, by identifying genes and determining their sequences, scientists have been able to make large quantities of valuable human "gene products." These include human insulin, interferon, Factor VIII, tumor necrosis factor, human growth hormone, tissue plasminogen activator, and numerous other compounds. Additionally, knowledge of gene sequences can provide the key to treatment or cure of genetic diseases (such as muscular dystrophy and cystic fibrosis).

SUMMARY OF THE INVENTION

The present invention relates to novel secreted proteins. More specifically, isolated nucleic acid molecules are provided encoding novel secreted polypeptides. Novel polypeptides and antibodies that bind to these polypeptides are provided. Also provided are vectors, host cells, and recombinant and synthetic methods for producing human polynucleotides and/or polypeptides, and antibodies. The invention further relates to diagnostic and therapeutic methods useful for diagnosing, treating, preventing and/or prognosing disorders related to these novel polypeptides. The invention further relates to screening methods for identifying agonists and antagonists of polynucleotides and polypeptides of the invention. The present invention further relates to methods and/or compositions for inhibiting or enhancing the production and function of the polypeptides of the present invention.

BRIEF DESCRIPTION OF THE DRAWINGS

FIGS. 1A-1C show the nucleotide sequence (SEQ ID NO:40) and the deduced amino acid sequence (SEQ ID NO:163) of the HCEJQ69 cDNA (Gene No:30).

Figure 2:
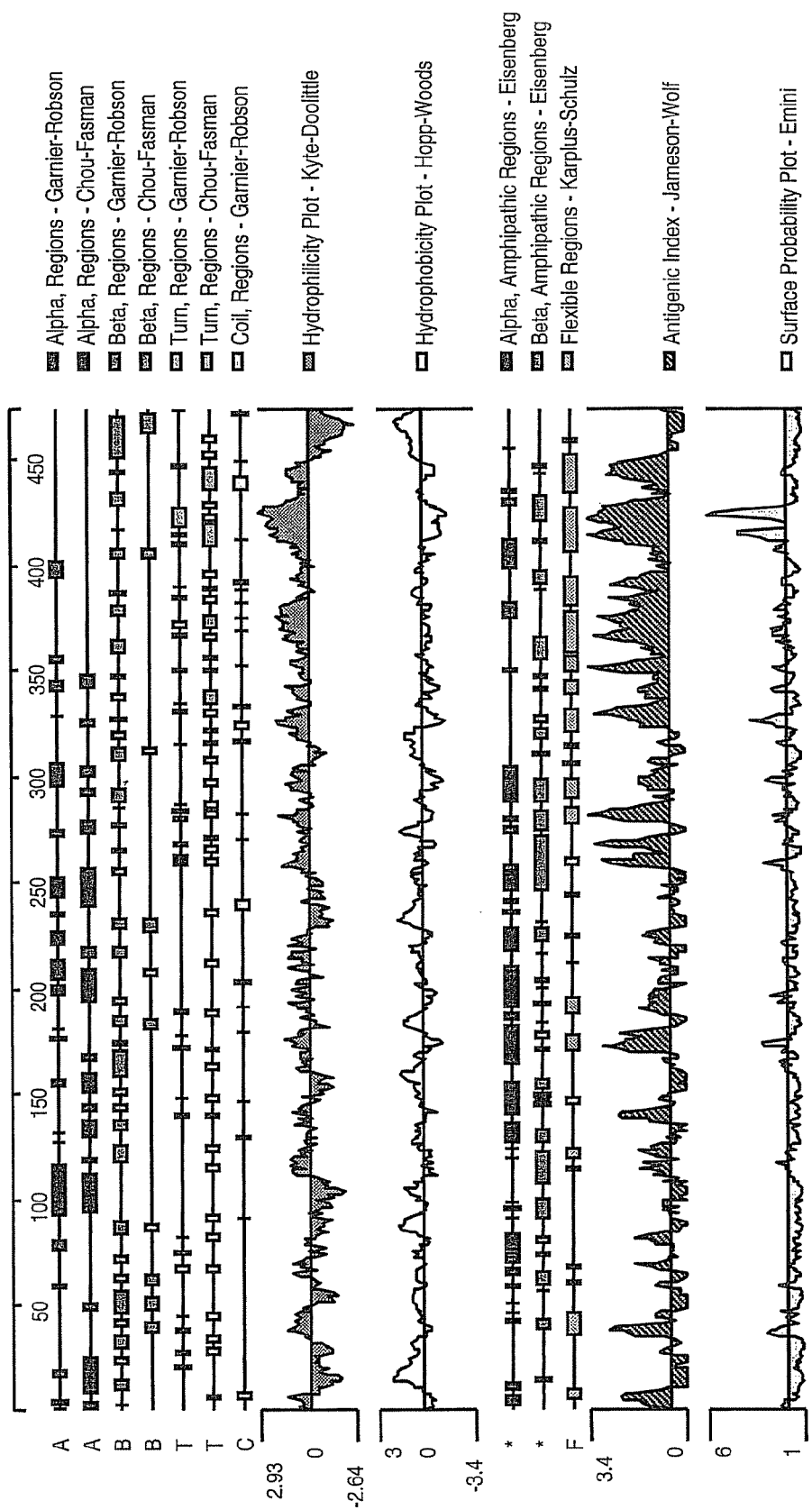
FIG. 2 shows an analysis of the amino acid sequence (SEQ ID NO:163). Alpha, beta, turn and coil regions; hydrophilicity and hydrophobicity; amphipathic regions; flexible regions; antigenic index and surface probability are shown, and all were generated using the default settings of the recited computer algorithms. In the "Antigenic Index or Jameson-Wolf" graph, the positive peaks indicate locations of the highly antigenic regions of the protein, i.e., regions from which epitope-bearing peptides of the invention can be obtained. Polypeptides comprising, or alternatively consisting of, domains defined by these graphs are contemplated by the present invention, as are polynucleotides encoding these polypeptides.

The data presented in FIG. 2 are also represented in tabular form in Table 6. The columns are labeled with the headings "Res", "Position", and Roman Numerals I-XIV. The column headings refer to the following features of the amino acid sequence presented in FIG. 2, and Table 6: "Res": amino acid residue of SEQ ID NO:534 and FIGS. 1A-1C; "Position": position of the corresponding residue within SEQ ID NO:534 and FIGS. 1A-1C; I: Alpha, Regions—Garnier-Robson; II: Alpha, Regions—Chou-Fasman; III: Beta, Regions—Garnier-Robson; IV: Beta, Regions—Chou-Fasman; V: Turn, Regions—Garnier-Robson; VI: Turn, Regions—Chou-Fasman; VII: Coil, Regions—Garnier-Robson; VIII: Hydrophilicity Plot—Kyte-Doolittle; IX: Hydrophobicity Plot—Hopp-Woods; X: Alpha, Amphipathic Regions—Eisenberg; XI: Beta, Amphipathic Regions—Eisenberg; XII: Flexible Regions—Karplus-Schulz; XIII: Antigenic Index—Jameson-Wolf; and XIV: Surface Probability Plot—Emini.

DETAILED DESCRIPTION

Polynucleotides and Polypeptides

Description of Table 1A

Table 1A summarizes information concerning certain polynucleotides and polypeptides of the invention. The first column provides the gene number in the application for each clone identifier. The second column provides a unique clone identifier, "Clone ID", for a cDNA clone related to each contig sequence disclosed in Table 1A. The cDNA Clones identified in the second column were deposited as indicated in the third column (i.e. by ATCC Deposit Number and deposit date). Some of the deposits contain multiple different clones corresponding to the same gene. In the fourth column, "Vector" refers to the type of vector contained in the corresponding cDNA Clone identified in the second column. In the fifth column, the nucleotide sequence identified as "NT SEQ ID NO:X" was assembled from partially homologous ("overlapping") sequences obtained from the corresponding cDNA clone identified in the second column and, in some cases, from additional related cDNA clones. The overlapping sequences were assembled into a single contiguous sequence of high redundancy (usually three to five overlapping sequences at each nucleotide position), resulting in a final sequence identified as SEQ ID NO:X. In the sixth column, "Total NT Seq." refers to the total number of nucleotides in the contig sequence identified as SEQ ID NO:X." The deposited clone may contain all or most of these sequences, reflected by the nucleotide position indicated as "5' NT of Clone Seq." (seventh column) and the "3' NT of Clone Seq." (eighth column) of SEQ ID NO:X. In the ninth column, the nucleotide position of SEQ ID NO:X of the putative start codon (methionine) is identified as "5' NT of Start Codon." Similarly, in column ten, the nucleotide position of SEQ ID NO:X of the predicted signal sequence is identified as "5' NT of First AA of Signal Pep." In the eleventh column, the translated amino acid sequence, beginning with the methionine, is identified as "AA SEQ ID NO:Y," although other reading frames can also be routinely translated using known molecular biology techniques. The polypeptides produced by these alternative open reading frames are specifically contemplated by the present invention.

In the twelfth and thirteenth columns of Table 1A, the first and last amino acid position of SEQ ID NO:Y of the predicted signal peptide is identified as "First AA of Sig Pep" and "Last AA of Sig Pep." In the fourteenth column, the predicted first amino acid position of SEQ ID NO:Y of the secreted portion is identified as "Predicted First AA of Secreted Portion". The amino acid position of SEQ ID NO:Y of the last amino acid encoded by the open reading frame is identified in the fifteenth column as "Last AA of ORF".

SEQ ID NO:X (where X may be any of the polynucleotide sequences disclosed in the sequence listing) and the translated SEQ ID NO:Y (where Y may be any of the polypeptide sequences disclosed in the sequence listing) are sufficiently accurate and otherwise suitable for a variety of uses well known in the art and described further below. For instance, SEQ ID NO:X is useful for designing nucleic acid hybridization probes that will detect nucleic acid sequences contained in SEQ ID NO:X or the cDNA contained in the deposited clone. These probes will also hybridize to nucleic acid molecules in biological samples, thereby enabling a variety of forensic and diagnostic methods of the invention. Similarly, polypeptides identified from SEQ ID NO:Y may be used, for example, to generate antibodies which bind specifically to proteins containing the polypeptides and the secreted proteins encoded by the cDNA clones identified in Table 1A and/or elsewhere herein.

Nevertheless, DNA sequences generated by sequencing reactions can contain sequencing errors. The errors exist as misidentified nucleotides, or as insertions or deletions of nucleotides in the generated DNA sequence. The erroneously inserted or deleted nucleotides cause frame shifts in the reading frames of the predicted amino acid sequence. In these cases, the predicted amino acid sequence diverges from the actual amino acid sequence, even though the generated DNA sequence may be greater than 99.9% identical to the actual DNA sequence (for example, one base insertion or deletion in an open reading frame of over 1000 bases).

Accordingly, for those applications requiring precision in the nucleotide sequence or the amino acid sequence, the present invention provides not only the generated nucleotide sequence identified as SEQ ID NO:X, and the predicted translated amino acid sequence identified as SEQ ID NO:Y, but also a sample of plasmid DNA containing a human cDNA of the invention deposited with the ATCC, as set forth in Table 1A. The nucleotide sequence of each deposited plasmid can readily be determined by sequencing the deposited plasmid in accordance with known methods The predicted amino acid sequence can then be verified from such deposits. Moreover, the amino acid sequence of the protein encoded by a particular plasmid can also be directly determined by peptide sequencing or by expressing the protein in a suitable host cell containing the deposited human cDNA, collecting the protein, and determining its sequence.

Also provided in Table 1A is the name of the vector which contains the cDNA plasmid. Each vector is routinely used in the art. The following additional information is provided for convenience.

Vectors Lambda Zap (U.S. Pat. Nos. 5,128,256 and 5,286,636), Uni-Zap XR (U.S. Pat. Nos. 5,128,256 and 5,286,636), Zap Express (U.S. Pat. Nos. 5,128,256 and 5,286,636), pBluescript (pBS) (Short, J. M. et al., *Nucleic Acids Res.* 16:7583-7600 (1988); Alting-Mees, M. A. and Short, J. M., *Nucleic Acids Res.* 17:9494 (1989)) and pBK (Alting-Mees, M. A. et al., *Strategies* 5:58-61 (1992)) are commercially available from Stratagene Cloning Systems, Inc., 11011 N. Torrey Pines Road, La Jolla, Calif., 92037. pBS contains an ampicillin resistance gene and pBK contains a neomycin resistance gene. Phagemid pBS may be excised from the Lambda Zap and Uni-Zap XR vectors, and phagemid pBK may be excised from the Zap Express vector. Both phagemids may be transformed into *E. coli* strain XL-1 Blue, also available from Stratagene.

Vectors pSport1, pCMVSport 1.0, pCMVSport 2.0 and pCMVSport 3.0, were obtained from Life Technologies, Inc., P.O. Box 6009, Gaithersburg, Md. 20897. All Sport vectors contain an ampicillin resistance gene and may be transformed into *E. coli* strain DH10B, also available from Life Technologies. See, for instance, Gruber, C. E., et al., *Focus* 15:59

(1993). Vector lafmid BA (Bento Soares, Columbia University, New York, N.Y.) contains an ampicillin resistance gene and can be transformed into *E. coli* strain XL-1 Blue. Vector pCR®2.1, which is available from Invitrogen, 1600 Faraday Avenue, Carlsbad, Calif. 92008, contains an ampicillin resistance gene and may be transformed into *E. coli* strain DH10B, available from Life Technologies. See, for instance, Clark, J. M., *Nuc. Acids Res.* 16:9677-9686 (1988) and Mead, D. et al., *Bio/Technology* 9: (1991).

The present invention also relates to the genes corresponding to SEQ ID NO:X, SEQ ID NO:Y, and/or a deposited cDNA (Clone ID). The corresponding gene can be isolated in accordance with known methods using the sequence information disclosed herein. Such methods include, but are not limited to, preparing probes or primers from the disclosed sequence and identifying or amplifying the corresponding gene from appropriate sources of genomic material.

Also provided in the present invention are allelic variants, orthologs, and/or species homologs. Procedures known in the art can be used to obtain full-length genes, allelic variants, splice variants, full-length coding portions, orthologs, and/or species homologs of genes corresponding to SEQ ID NO:X and SEQ ID NO:Y using information from the sequences disclosed herein or the clones deposited with the ATCC. For example, allelic variants and/or species homologs may be isolated and identified by making suitable probes or primers from the sequences provided herein and screening a suitable nucleic acid source for allelic variants and/or the desired homologue.

The present invention provides a polynucleotide comprising, or alternatively consisting of, the nucleic acid sequence of SEQ ID NO:X and/or a cDNA contained in ATCC Deposit NO:Z. The present invention also provides a polypeptide comprising, or alternatively, consisting of, the polypeptide sequence of SEQ ID NO:Y, a polypeptide encoded by SEQ ID NO:X, and/or a polypeptide encoded by a cDNA contained in ATCC Deposit NO:Z. Polynucleotides encoding a polypeptide comprising, or alternatively consisting of the polypeptide sequence of SEQ ID NO:Y, a polypeptide encoded by SEQ ID NO:X and/or a polypeptide encoded by the cDNA contained in ATCC Deposit NO:Z, are also encompassed by the invention. The present invention further encompasses a polynucleotide comprising, or alternatively consisting of the complement of the nucleic acid sequence of SEQ ID NO:X, and/or the complement of the coding strand of the cDNA contained in ATCC Deposit NO:Z.

Description of Table 1B

Table 1B summarizes some of the polynucleotides encompassed by the invention (including cDNA clones related to the sequences (Clone ID), contig sequences (contig identifier (Contig ID:) and contig nucleotide sequence identifier (SEQ ID NO:X)) and further summarizes certain characteristics of these polynucleotides and the polypeptides encoded thereby. The first column provides the gene number in the application for each clone identifier. The second column provides a unique clone identifier, "Clone ID", for a cDNA clone related to each contig sequence disclosed in Table 1A and/or 1B. The third column provides a unique contig identifier, "Contig ID:" for each of the contig sequences disclosed in Table 1B. The fourth column provides the sequence identifier, "SEQ ID NO:X", for each of the contig sequences disclosed in Table 1A and/or 1B. The fifth column, "ORF (From-To)", provides the location (i.e., nucleotide position numbers) within the polynucleotide sequence of SEQ ID NO:X that delineate the preferred open reading frame (ORF) that encodes the amino acid sequence shown in the sequence listing and referenced in Table 1B as SEQ ID NO:Y (column 6). Column 7 lists residues comprising predicted epitopes contained in the polypeptides encoded by each of the preferred ORFs (SEQ ID NO:Y). Identification of potential immunogenic regions was performed according to the method of Jameson and Wolf (CABIOS, 4; 181-186 (1988)); specifically, the Genetics Computer Group (GCG) implementation of this algorithm, embodied in the program PEPTIDESTRUCTURE (Wisconsin Package v10.0, Genetics Computer Group (GCG), Madison, Wis.). This method returns a measure of the probability that a given residue is found on the surface of the protein. Regions where the antigenic index score is greater than 0.9 over at least 6 amino acids are indicated in Table 1B as "Predicted Epitopes". In particular embodiments, polypeptides of the invention comprise, or alternatively consist of, one, two, three, four, five or more of the predicted epitopes described in Table 1B. It will be appreciated that depending on the analytical criteria used to predict antigenic determinants, the exact address of the determinant may vary slightly. Column 8, "Tissue Distribution" shows the expression profile of tissue, cells, and/or cell line libraries which express the polynucleotides of the invention. The first number in column 8 (preceding the colon), represents the tissue/cell source identifier code corresponding to the key provided in Table 4. Expression of these polynucleotides was not observed in the other tissues and/or cell libraries tested. For those identifier codes in which the first two letters are not "AR", the second number in column 8 (following the colon), represents the number of times a sequence corresponding to the reference polynucleotide sequence (e.g., SEQ ID NO:X) was identified in the tissue/cell source. Those tissue/cell source identifier codes in which the first two letters are "AR" designate information generated using DNA array technology. Utilizing this technology, cDNAs were amplified by PCR and then transferred, in duplicate, onto the array. Gene expression was assayed through hybridization of first strand cDNA probes to the DNA array. cDNA probes were generated from total RNA extracted from a variety of different tissues and cell lines. Probe synthesis was performed in the presence of $^{33}$P dCTP, using oligo(dT) to prime reverse transcription. After hybridization, high stringency washing conditions were employed to remove non-specific hybrids from the array. The remaining signal, emanating from each gene target, was measured using a Phosphorimager. Gene expression was reported as Phosphor Stimulating Luminescence (PSL) which reflects the level of phosphor signal generated from the probe hybridized to each of the gene targets represented on the array. A local background signal subtraction was performed before the total signal generated from each array was used to normalize gene expression between the different hybridizations. The value presented after "[array code]:" represents the mean of the duplicate values, following background subtraction and probe normalization. One of skill in the art could routinely use this information to identify normal and/or diseased tissue(s) which show a predominant expression pattern of the corresponding polynucleotide of the invention or to identify polynucleotides which show predominant and/or specific tissue and/or cell expression. Column 9 provides the chromosomal location of polynucleotides corresponding to SEQ ID NO:X. Chromosomal location was determined by finding exact matches to EST and cDNA sequences contained in the NCBI (National Center for Biotechnology Information) Uni-Gene database. Given a presumptive chromosomal location, disease locus association was determined by comparison with the Morbid Map, derived from Online Mendelian Inheritance in Man (Online Mendelian Inheritance in Man, OMIMT™. McKusick-Nathans Institute for Genetic Medicine, Johns Hopkins University (Baltimore, Md.) and National Center for Biotechnology Information, National Library of Medicine (Bethesda, Md.) 2000. World Wide Web URL: http://www.ncbi.nlm.nih.gov/omim/) If the putative chromosomal location of the Query overlaps with the chromosomal location of a Morbid Map entry, an OMIM identification number is disclosed in column 10 labeled "OMIM Disease Reference(s)". A key to the OMIM reference identification numbers is provided in Table 5.

Description of Table 1C

Table 1C: In preferred embodiments, the present invention encompasses a method of treating a disease or disorder listed in the "FEATURES OF PROTEIN" sections (below) and also as listed in the "Preferred Indications" column of Table 1C (below); comprising administering to a patient in which such treatment, prevention, or amelioration is desired a protein, nucleic acid, or antibody of the invention (or fragment or variant thereof) represented by Table 1A and Table 1C (in the same row as the disease or disorder to be treated is listed in the "Preferred Indications" column of Table 1C) in an amount effective to treat, prevent, or ameliorate the disease or disorder.

As indicated in Table 1C, the polynucleotides, polypeptides, agonists, or antagonists of the present invention (including antibodies) can be used in assays known in the art to test for one or more of the recited biological activities. If these polynucleotides and polypeptides do exhibit activity in a particular assay, it is likely that these molecules may be involved in the diseases associated with the biological activity. Thus, the polynucleotides or polypeptides, or agonists or antagonists thereof (including antibodies) could be used to treat the associated disease.

The present invention encompasses methods of preventing, treating, diagnosing, or ameliorating a disease or disorder. In preferred embodiments, the present invention encompasses a method of treating a disease or disorder listed in the "Preferred Indications" column of Table 1C; comprising administering to a patient in which such treatment, prevention, or amelioration is desired a protein, nucleic acid, or antibody of the invention (or fragment or variant thereof) in an amount effective to treat, prevent, diagnose, or ameliorate the disease or disorder. The first and second columns of Table 1C show the "Gene No." and "Clone ID", respectively, indicating certain nucleic acids and proteins (or antibodies against the same) of the invention (including polynucleotide, polypeptide, and antibody fragments or variants thereof) that may be used in preventing, treating, diagnosing, or ameliorating the disease(s) or disorder(s) indicated in the corresponding row in Column 3 of Table 1C.

In another embodiment, the present invention also encompasses methods of preventing, treating, diagnosing, or ameliorating a disease or disorder listed in the "Preferred Indications" column of Table 1C; comprising administering to a patient combinations of the proteins, nucleic acids, or antibodies of the invention (or fragments or variants thereof), sharing similar indications as shown in the corresponding rows in Column 3 of Table 1C.

The "Preferred Indication" column describes diseases, disorders, and/or conditions that may be treated, prevented, diagnosed, or ameliorated by a protein, nucleic acid, or antibody of the invention (or fragment or variant thereof).

The recitation of "Cancer" in the "Preferred Indication" column indicates that the corresponding nucleic acid and protein, or antibody against the same, of the invention (or fragment or variant thereof) may be used for example, to diagnose, treat, prevent, and/or ameliorate diseases and/or disorders relating to neoplastic diseases (e.g., leukemias, cancers, and/or as described below under "Hyperproliferative Disorders").

In specific embodiments, a protein, nucleic acid, or antibody of the invention (or fragment or variant thereof) having a "Cancer" recitation in the "Preferred Indication" column of Table 1C may be used for example, to diagnose, treat, prevent, and/or ameliorate a neoplasm located in a tissue selected from the group consisting of: colon, abdomen, bone, breast, digestive system, liver, pancreas, prostate, peritoneum, lung, blood (e.g., leukemia), endocrine glands (adrenal, parathyroid, pituitary, testicles, ovary, thymus, thyroid), uterus, eye, head and neck, nervous (central and peripheral), lymphatic system, pelvic, skin, soft tissue, spleen, thoracic, and urogenital.

In specific embodiments, a protein, nucleic acid, or antibody of the invention (or fragment or variant thereof) having a "Cancer" recitation in the "Preferred Indication" column of Table 1C, may be used for example, to diagnose, treat, prevent, and/or ameliorate a pre-neoplastic condition, selected from the group consisting of: hyperplasia (e.g., endometrial hyperplasia and/or as described in the section entitled "Hyperproliferative Disorders"), metaplasia (e.g., connective tissue metaplasia, atypical metaplasia, and/or as described in the section entitled "Hyperproliferative Disorders"), and/or dysplasia (e.g., cervical dysplasia, and bronchopulmonary dysplasia).

In another specific embodiment, a protein, nucleic acid, or antibody of the invention (or fragment or variant thereof) having a "Cancer" recitation in the "Preferred Indication" column of Table 1C, may be used for example, to diagnose, treat, prevent, and/or ameliorate a benign dysproliferative disorder selected from the group consisting of: benign tumors, fibrocystic conditions, tissue hypertrophy, and/or as described in the section entitled "Hyperproliferative Disorders".

The recitation of "Immune/Hematopoietic" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders"), blood disorders (e.g., as described below under "Immune Activity" "Cardiovascular Disorders" and/or "Blood-Related Disorders"), and infections (e.g., as described below under "Infectious Disease").

In specific embodiments, a protein, nucleic acid, or antibody of the invention (or fragment or variant thereof) having the "Immune/Hematopoietic" recitation in the "Preferred Indication" column of Table 1C, may be used for example, to diagnose, treat, prevent, and/or ameliorate a disease or disorder selected from the group consisting of: anemia, pancytopenia, leukopenia, thrombocytopenia, leukemias, Hodgkin's disease, non-Hodgkin's lymphoma, acute lymphocytic anemia (ALL), plasmacytomas, multiple myeloma, Burkitt's lymphoma, arthritis, asthma, AIDS, autoimmune disease, rheumatoid arthritis, granulomatous disease, immune deficiency, inflammatory bowel disease, sepsis, neutropenia, neutrophilia, psoriasis, immune reactions to transplanted organs and tissues, systemic lupus erythematosis, hemophilia, hypercoagulation, diabetes mellitus, endocarditis, meningitis, Lyme Disease, and allergies.

The recitation of "Reproductive" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders"), and disorders of the reproductive system (e.g., as described below under "Reproductive System Disorders").

In specific embodiments, a protein, nucleic acid, or antibody of the invention (or fragment or variant thereof) having a "Reproductive" recitation in the "Preferred Indication" column of Table 1C, may be used for example, to diagnose, treat, prevent, and/or ameliorate a disease or disorder selected from the group consisting of: cryptorchism, prostatitis, inguinal hernia, varicocele, leydig cell tumors, verrucous carcinoma, prostatitis, malacoplakia, Peyronie's disease, penile carcinoma, squamous cell hyperplasia, dysmenorrhea, ovarian adenocarcinoma, Turner's syndrome, mucopurulent cervicitis, Sertoli-leydig tumors, ovarian cancer, uterine cancer, pelvic inflammatory disease, testicular cancer, prostate cancer, Klinefelter's syndrome, Young's syndrome, premature ejaculation, diabetes mellitus, cystic fibrosis, Kartagener's syndrome, testicular atrophy, testicular feminization, anorchia, ectopic testis, epididymitis, orchitis, gonorrhea, syphilis, testicular torsion, vasitis nodosa, germ cell tumors, stromal tumors, dysmenorrhea, retroverted uterus, endometriosis, fibroids, adenomyosis, anovulatory bleeding, amenorrhea, Cushing's syndrome, hydatidiform moles, Asherman's syndrome, premature menopause, precocious puberty, uterine polyps, dysfunctional uterine bleeding, cervicitis, chronic cervicitis, mucopurulent cervicitis, cervical dysplasia, cervical polyps, Nabothian cysts, cervical erosion, cervical incompetence, cervical neoplasms, pseudohermaphroditism, and premenstrual syndrome.

The recitation of "Musculoskeletal" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders"), and disorders of the immune system (e.g., as described below under "Immune Activity").

In specific embodiments, a protein, nucleic acid, or antibody of the invention (or fragment or variant thereof) having a "Musculoskeletal" recitation in the "Preferred Indication" column of Table 1C, may be used for example, to diagnose, treat, prevent, and/or ameliorate a disease or disorder selected from the group consisting of: bone cancers (e.g., osteochondromas, benign chondromas, chondroblastoma, chondromyxoid fibromas, osteoid osteomas, giant cell tumors, multiple myeloma, osteosarcomas), Paget's Disease, rheumatoid arthritis, systemic lupus erythematosus, osteomyelitis, Lyme Disease, gout, bursitis, tendonitis, osteoporosis, osteoarthritis, muscular dystrophy, mitochondrial myopathy, cachexia, and multiple sclerosis.

The recitation of "Cardiovascular" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders"), and disorders of the cardiovascular system (e.g., as described below under "Cardiovascular Disorders").

In specific embodiments, a protein, nucleic acid, or antibody of the invention (or fragment or variant thereof) having a "Cardiovascular" recitation in the "Preferred Indication" column of Table 1C, may be used for example, to diagnose, treat, prevent, and/or ameliorate a disease or disorder selected from the group consisting of: myxomas, fibromas, rhabdomyomas, cardiovascular abnormalities (e.g., congenital heart defects, cerebral arteriovenous malformations, septal defects), heart disease (e.g., heart failure, congestive heart disease, arrhythmia, tachycardia, fibrillation, pericardial Disease, endocarditis), cardiac arrest, heart valve disease (e.g., stenosis, regurgitation, prolapse), vascular disease (e.g., hypertension, coronary artery disease, angina, aneurysm, arteriosclerosis, peripheral vascular disease), hyponatremia, hypernatremia, hypokalemia, and hyperkalemia.

The recitation of "Mixed Fetal" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders").

In specific embodiments, a protein, nucleic acid, or antibody of the invention (or fragment or variant thereof) having a "Mixed Fetal" recitation in the "Preferred Indication" column of Table 1C, may be used for example, to diagnose, treat, prevent, and/or ameliorate a disease or disorder selected from the group consisting of: spina bifida, hydranencephaly, neurofibromatosis, fetal alcohol syndrome, diabetes mellitus, PKU, Down's syndrome, Patau syndrome, Edwards syndrome, Turner syndrome, Apert syndrome, Carpenter syndrome, Conradi syndrome, Crouzon syndrome, cutis laxa, Cornelia de Lange syndrome, Ellis-van Creveld syndrome, Holt-Oram syndrome, Kartagener syndrome, Meckel-Gruber syndrome, Noonan syndrome, Pallister-Hall syndrome, Rubinstein-Taybi syndrome, Scimitar syndrome, Smith-Lemli-Opitz syndrome, thromocytopenia-absent radius (TAR) syndrome, Treacher Collins syndrome, Williams syndrome, Hirschsprung's disease, Meckel's diverticulum, polycystic kidney disease, Turner's syndrome, and gonadal dysgenesis, Klippel-Feil syndrome, Ostogenesis imperfecta, muscular dystrophy, Tay-Sachs disease, Wilm's tumor, neuroblastoma, and retinoblastoma.

The recitation of "Excretory" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders") and renal disorders (e.g., as described below under "Renal Disorders").

In specific embodiments, a protein, nucleic acid, or antibody of the invention (or fragment or variant thereof) having a "Excretory" recitation in the "Preferred Indication" column of Table 1C, may be used for example, to diagnose, treat, prevent, and/or ameliorate a disease or disorder selected from the group consisting of: bladder cancer, prostate cancer, benign prostatic hyperplasia, bladder disorders (e.g., urinary incontinence, urinary retention, urinary obstruction, urinary tract Infections, interstitial cystitis, prostatitis, neurogenic bladder, hematuria), renal disorders (e.g., hydronephrosis, proteinuria, renal failure, pyelonephritis, urolithiasis, reflux nephropathy, and unilateral obstructive uropathy).

The recitation of "Neural/Sensory" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders") and diseases or disorders of the nervous system (e.g., as described below under "Neural Activity and Neurological Diseases").

In specific embodiments, a protein, nucleic acid, or antibody of the invention (or fragment or variant thereof) having a "Neural/Sensory" recitation in the "Preferred Indication" column of Table 1C, may be used for example, to diagnose, treat, prevent, and/or ameliorate a disease or disorder selected from the group consisting of: brain cancer (e.g., brain stem glioma, brain tumors, central nervous system (Primary) lymphoma, central nervous system lymphoma, cerebellar astrocytoma, and cerebral astrocytoma, neurodegenerative disorders (e.g., Alzheimer's Disease, Creutzfeldt-Jakob Disease, Parkinson's Disease, and Idiopathic Presenile Dementia), encephalomyelitis, cerebral malaria, meningitis, metabolic brain diseases (e.g., phenylketonuria and pyruvate carboxylase deficiency), cerebellar ataxia, ataxia telangiectasia, and AIDS Dementia Complex, schizophrenia, attention deficit disorder, hyperactive attention deficit disorder, autism, and obsessive compulsive disorders.

The recitation of "Respiratory" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders") and diseases or disorders of the respiratory system (e.g., as described below under "Respiratory Disorders").

In specific embodiments, a protein, nucleic acid, or antibody of the invention (or fragment or variant thereof) having a "Respiratory" recitation in the "Preferred Indication" column of Table 1C, may be used for example, to diagnose, treat, prevent, and/or ameliorate a disease or disorder selected from the group consisting of: cancers of the respiratory system such as larynx cancer, pharynx cancer, trachea cancer, epiglottis cancer, lung cancer, squamous cell carcinomas, small cell (oat cell) carcinomas, large cell carcinomas, and adenocarcinomas. Allergic reactions, cystic fibrosis, sarcoidosis, histiocytosis X, infiltrative lung diseases (e.g., pulmonary fibrosis and lymphoid interstitial pneumonia), obstructive airway diseases (e.g., asthma, emphysema, chronic or acute bronchitis), occupational lung diseases (e.g., silicosis and asbestosis), pneumonia, and pleurisy.

The recitation of "Endocrine" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders") and diseases or disorders of the respiratory system (e.g., as described below under "Respiratory Disorders"), renal disorders (e.g., as described below under "Renal Disorders"), and disorders of the endocrine system (e.g., as described below under "Endocrine Disorders".

In specific embodiments, a protein, nucleic acid, or antibody of the invention (or fragment or variant thereof) having an "Endocrine" recitation in the "Preferred Indication" column of Table 1C, may be used for example, to diagnose, treat, prevent, and/or ameliorate a disease or disorder selected from the group consisting of: cancers of endocrine tissues and organs (e.g., cancers of the hypothalamus, pituitary gland, thyroid gland, parathyroid glands, pancreas, adrenal glands, ovaries, and testes), diabetes (e.g., diabetes insipidus, type I and type II diabetes mellitus), obesity, disorders related to pituitary glands (e.g., hyperpituitarism, hypopituitarism, and pituitary dwarfism), hypothyroidism, hyperthyroidism, goiter, reproductive disorders (e.g. male and female infertility), disorders related to adrenal glands (e.g., Addison's Disease, corticosteroid deficiency, and Cushing's Syndrome), kidney cancer (e.g., hypernephroma, transitional cell cancer, and Wilm's tumor), diabetic nephropathy, interstitial nephritis, polycystic kidney disease, glomerulonephritis (e.g., IgM mesangial proliferative glomerulonephritis and glomerulonephritis caused by autoimmune disorders; such as Goodpasture's syndrome), and nephrocalcinosis.

The recitation of "Digestive" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders") and diseases or disorders of the gastrointestinal system (e.g., as described below under "Gastrointestinal Disorders".

In specific embodiments, a protein, nucleic acid, or antibody of the invention (or fragment or variant thereof) having a "Digestive" recitation in the "Preferred Indication" column of Table 1C, may be used for example, to diagnose, treat, prevent, and/or ameliorate a disease or disorder selected from the group consisting of: ulcerative colitis, appendicitis, Crohn's disease, hepatitis, hepatic encephalopathy, portal hypertension, cholelithiasis, cancer of the digestive system (e.g., biliary tract cancer, stomach cancer, colon cancer, gastric cancer, pancreatic cancer, cancer of the bile duct, tumors of the colon (e.g., polyps or cancers), and cirrhosis), pancreatitis, ulcerative disease, pyloric stenosis, gastroenteritis, gastritis, gastric atropy, benign tumors of the duodenum, distension, irritable bowel syndrome, malabsorption, congenital disorders of the small intestine, bacterial and parasitic infection, megacolon, Hirschsprung's disease, aganglionic megacolon, acquired megacolon, colitis, anorectal disorders (e.g., anal fistulas, hemorrhoids), congenital disorders of the liver (e.g., Wilson's disease, hemochromatosis, cystic fibrosis, biliary atresia, and alpha1-antitrypsin deficiency), portal hypertension, cholelithiasis, and jaundice.

The recitation of "Connective/Epithelial" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders"), cellular and genetic abnormalities (e.g., as described below under "Diseases at the Cellular Level"), angiogenesis (e.g., as described below under "Anti-Angiogenesis Activity"), and or to promote or inhibit regeneration (e.g., as described below under "Regeneration"), and wound healing (e.g., as described below under "Wound Healing and Epithelial Cell Proliferation").

In specific embodiments, a protein, nucleic acid, or antibody of the invention (or fragment or variant thereof) having a "Connective/Epithelial" recitation in the "Preferred Indication" column of Table 1C, may be used for example, to diagnose, treat, prevent, and/or ameliorate a disease or disorder selected from the group consisting of: connective tissue metaplasia, mixed connective tissue disease, focal epithelial hyperplasia, epithelial metaplasia, mucoepithelial dysplasia, graft v. host disease, polymyositis, cystic hyperplasia, cerebral dysplasia, tissue hypertrophy, Alzheimer's disease, lymphoproliferative disorder, Waldenstron's macroglobulinemia, Crohn's disease, pernicious anemia, idiopathic Addison's disease, glomerulonephritis, bullous pemphigoid, Sjogren's syndrome, diabetes mellitus, cystic fibrosis, osteoblastoma, osteoclastoma, osteosarcoma, chondrosarcoma, osteoporosis, osteocartritis, periodontal disease, wound healing, relapsing polychondritis, vasculitis, polyarteritis nodosa, Wegener's granulomatosis, cellulitis, rheumatoid arthritis, psoriatic arthritis, discoid lupus erythematosus, systemic lupus erythematosus, scleroderma, CREST syndrome, Sjogren's syndrome, polymyositis, dermatomyositis, mixed connective tissue disease, relapsing polychondritis, vasculitis, Henoch-Schonlein syndrome, erythema nodosum, polyarteritis nodosa, temporal (giant cell) arteritis, Takayasu's arteritis, Wegener's granulomatosis, Reiter's syndrome, Behcet's syndrome, ankylosing spondylitis, cellulitis, keloids, Ehler Danlos syndrome, Marfan syndrome, pseudoxantoma elasticum, osteogenese imperfecta, chondrodysplasias, epidermolysis bullosa, Alport syndrome, and cutis laxa.

Description of Table 1D

Table 1D provides information related to biological activities and preferred indications for polynucleotides and polypeptides of the invention (including antibodies, agonists, and/or antagonists thereof). Table 1D also provides information related to assays which may be used to test polynucleotides and polypeptides of the invention (including antibodies, agonists, and/or antagonists thereof) for the corresponding biological activities. The first column ("Gene No.") provides the gene number in the application for each clone identifier. The second column ("Clone ID") provides the unique clone identifier for each clone as previously described and indicated in Tables 1A, 1B, and 1C. The third column ("AA SEQ ID NO:Y") indicates the Sequence Listing SEQ ID Number for polypeptide sequences encoded by the corresponding cDNA clones (also as indicated in Tables 1A, 1B, and 2). The fourth column ("Biological Activity") indicates a biological activity corresponding to the indicated polypeptides (or polynucleotides encoding said polypeptides). The fifth column ("Exemplary Activity Assay") further describes the corresponding biological activity and provides information pertaining to the various types of assays which may be performed to test, demonstrate, or quantify the corresponding biological activity. The sixth column ("Preferred Indications") describes particular embodiments of the invention and indications (e.g. pathologies, diseases, disorders, abnormalities, etc.) for which polynucleotides and polypeptides of the invention (including antibodies, agonists, and/or antagonists thereof) may be used in detecting, diagnosing, preventing, and/or treating.

Table 1D describes the use of FMAT technology, inter alia, for testing or demonstrating various biological activities. Fluorometric microvolume assay technology (FMAT) is a fluorescence-based system which provides a means to perform nonradioactive cell- and bead-based assays to detect activation of cell signal transduction pathways. This technology was designed specifically for ligand binding and immunological assays. Using this technology, fluorescent cells or beads at the bottom of the well are detected as localized areas of concentrated fluorescence using a data processing system. Unbound fluorophore comprising the background signal is ignored, allowing for a wide variety of homogeneous assays. FMAT technology may be used for peptide ligand binding assays, immunofluorescence, apoptosis, cytotoxicity, and bead-based immunocapture assays. See, Miraglia S et. al., "Homogeneous cell and bead based assays for highthroughput screening using fluorometric microvolume assay technology," Journal of Biomolecular Screening; 4:193-204 (1999). In particular, FMAT technology may be used to test, confirm, and/or identify the ability of polypeptides (including polypeptide fragments and variants) to activate signal transduction pathways. For example, FMAT technology may be used to test, confirm, and/or identify the ability of polypeptides to upregulate production of immunomodulatory proteins (such as, for example, interleukins, GM-CSF, Rantes, and Tumor Necrosis factors, as well as other cellular regulators (e.g. insulin)).

Table 1D also describes the use of kinase assays for testing, demonstrating, or quantifying biological activity. In this regard, the phosphorylation and de-phosphorylation of specific amino acid residues (e.g. Tyrosine, Serine, Threonine) on cell-signal transduction proteins provides a fast, reversible means for activation and de-activation of cellular signal transduction pathways. Moreover, cell signal transduction via phosphorylation/de-phosphorylation is crucial to the regulation of a wide variety of cellular processes (e.g. proliferation, differentiation, migration, apoptosis, etc.). Accordingly, kinase assays provide a powerful tool useful for testing, confirming, and/or identifying polypeptides (including polypeptide fragments and variants) that mediate cell signal transduction events via protein phosphorylation. See e.g., Forrer, P., Tamaskovic R., and Jaussi, R. "Enzyme-Linked Immunosorbent Assay for Measurement of JNK, ERK, and p38 Kinase Activities" Biol. Chem. 379(8-9): 1101-1110 (1998).

Description of Table 2

Table 2 summarizes homology and features of some of the polypeptides of the invention. The first column provides a unique clone identifier, "Clone ID", corresponding to a cDNA clone disclosed in Table 1A or 1B. The second column provides the unique contig identifier, "Contig ID:" corresponding to contigs in Table 1A and 1B and allowing for correlation with the information in Table 1A and 1B. The third column provides the sequence identifier, "SEQ ID NO:X", for the contig polynucleotide sequence. The fourth column provides the analysis method by which the homology/identity disclosed in the Table was determined Comparisons were made between polypeptides encoded by the polynucleotides of the invention and either a non-redundant protein database (herein referred to as "NR"), or a database of protein families (herein referred to as "PFAM") as further described below. The fifth column provides a description of the PFAM/NR hit having a significant match to a polypeptide of the invention. Column six provides the accession number of the PFAM/NR hit disclosed in the fifth column. Column seven, "Score/Percent Identity", provides a quality score or the percent identity, of the hit disclosed in columns five and six. Columns 8 and 9, "NT From" and "NT To" respectively, delineate the polynucleotides in "SEQ ID NO:X" that encode a polypeptide having a significant match to the PFAM/NR database as disclosed in the fifth and sixth columns. In specific embodiments polypeptides of the invention comprise, or alternatively consist of, an amino acid sequence encoded by a polynucleotide in SEQ ID NO:X as delineated in columns 8 and 9, or fragments or variants thereof.

Description of Table 3

Table 3 provides polynucleotide sequences that may be disclaimed according to certain embodiments of the invention. The first column provides a unique clone identifier, "Clone ID", for a cDNA clone related to contig sequences disclosed in Table 1B. The second column provides the sequence identifier, "SEQ ID NO:X", for contig sequences disclosed in Table 1A and/or 1B. The third column provides the unique contig identifier, "Contig ID:", for contigs disclosed in Table 1B. The fourth column provides a unique integer 'a' where 'a' is any integer between 1 and the final nucleotide minus 15 of SEQ ID NO:X, and the fifth column provides a unique integer 'b' where 'b' is any integer between 15 and the final nucleotide of SEQ ID NO:X, where both a and b correspond to the positions of nucleotide residues shown in SEQ ID NO:X, and where b is greater than or equal to a +14. For each of the polynucleotides shown as SEQ ID NO:X, the uniquely defined integers can be substituted into the general formula of a-b, and used to describe polynucleotides which may be preferably excluded from the invention. In certain embodiments, preferably excluded from the invention are at least one, two, three, four, five, ten, or more of the polynucleotide sequence(s) having the accession number(s) disclosed in the sixth column of this Table. In further embodiments, preferably excluded from the invention are the specific polynucleotide sequence(s) contained in the clones corresponding to at least one, two, three, four, five, ten, or more of the available material having the accession numbers identified in the sixth column of this Table (including for example, the actual sequence contained in an identified BAC clone).

Description of Table 4

Table 4 provides a key to the tissue/cell source identifier code disclosed in Table 1B, column 8 Column 1 provides the tissue/cell source identifier code disclosed in Table 1B, Column 8. Columns 2-5 provide a description of the tissue or cell source. Codes corresponding to diseased tissues are indicated in column 6 with the word "disease". The use of the word "disease" in column 6 is non-limiting. The tissue or cell source may be specific (e.g. a neoplasm), or may be disease-associated (e.g., a tissue sample from a normal portion of a diseased organ). Furthermore, tissues and/or cells lacking the "disease" designation may still be derived from sources directly or indirectly involved in a disease state or disorder, and therefore may have a further utility in that disease state or disorder. In numerous cases where the tissue/cell source is a library, column 7 identifies the vector used to generate the library.

Description of Table 5

Table 5 provides a key to the OMIM reference identification numbers disclosed in Table 1B, column 10. OMIM reference identification numbers (Column 1) were derived from Online Mendelian Inheritance in Man (Online Mendelian Inheritance in Man, OMIM. McKusick-Nathans Institute for Genetic Medicine, Johns Hopkins University (Baltimore, Md.) and National Center for Biotechnology Information, National Library of Medicine, (Bethesda, Md.) 2000. World Wide Web URL: http://www.ncbi.nlm.nih.gov/omim/). Column 2 provides diseases associated with the cytologic band disclosed in Table 1B, column 9, as determined using the Morbid Map database.

DEFINITIONS

The following definitions are provided to facilitate understanding of certain terms used throughout this specification.

In the present invention, "isolated" refers to material removed from its original environment (e.g., the natural environment if it is naturally occurring), and thus is altered "by the hand of man" from its natural state. For example, an isolated polynucleotide could be part of a vector or a composition of matter, or could be contained within a cell, and still be "isolated" because that vector, composition of matter, or particular cell is not the original environment of the polynucleotide. The term "isolated" does not refer to genomic or cDNA libraries, whole cell total or mRNA preparations, genomic DNA preparations (including those separated by electrophoresis and transferred onto blots), sheared whole cell genomic DNA preparations or other compositions where the art demonstrates no distinguishing features of the polynucleotide/sequences of the present invention.

In the present invention, a "secreted" protein refers to those proteins capable of being directed to the ER, secretory vesicles, or the extracellular space as a result of a signal sequence, as well as those proteins released into the extracellular space without necessarily containing a signal sequence. If the secreted protein is released into the extracellular space, the secreted protein can undergo extracellular processing to produce a "mature" protein. Release into the extracellular space can occur by many mechanisms, including exocytosis and proteolytic cleavage.

As used herein, a "polynucleotide" refers to a molecule having a nucleic acid sequence contained in SEQ ID NO:X (as described in column 5 of Table 1A), or cDNA clone (as described in column 2 of Table 1A and contained within a pool of plasmids deposited with the ATCC in ATCC Deposit No:Z). For example, the polynucleotide can contain the nucleotide sequence of the full length cDNA sequence, including the 5' and 3' untranslated sequences, the coding region, with or without a natural or artificial signal sequence, the protein coding region, as well as fragments, epitopes, domains, and variants of the nucleic acid sequence. Moreover, as used herein, a "polypeptide" refers to a molecule having an amino acid sequence encoded by a polynucleotide of the invention as broadly defined (obviously excluding poly-Phenylalanine or poly-Lysine peptide sequences which result from translation of a polyA tail of a sequence corresponding to a cDNA).

In the present invention, a representative plasmid containing the sequence of SEQ ID NO:X was deposited with the American Type Culture Collection ("ATCC") and/or described in Table 1A. As shown in Table 1A, each cDNA is identified by a cDNA clone identifier and the ATCC Deposit Number (ATCC Deposit No:Z). Plasmids that were pooled and deposited as a single deposit have the same ATCC Deposit Number. The ATCC is located at 10801 University Boulevard, Manassas, Va. 20110-2209, USA. The ATCC deposit was made pursuant to the terms of the Budapest Treaty on the international recognition of the deposit of microorganisms for purposes of patent procedure.

A "polynucleotide" of the present invention also includes those polynucleotides capable of hybridizing, under stringent hybridization conditions, to sequences contained in SEQ ID NO:X, or the complement thereof (e.g., the complement of any one, two, three, four, or more of the polynucleotide fragments described herein) and/or sequences of the cDNA contained in the deposited clone (e.g., the complement of any one, two, three, four, or more of the polynucleotide fragments described herein). "Stringent hybridization conditions" refers to an overnight incubation at 42 degree C. in a solution comprising 50% formamide, 5×SSC (750 mM NaCl, 75 mM trisodium citrate), 50 mM sodium phosphate (pH 7.6), 5×Denhardt's solution, 10% dextran sulfate, and 20 µg/ml denatured, sheared salmon sperm DNA, followed by washing the filters in 0.1×SSC at about 65 degree C.

Also included within "polynucleotides" of the present invention are nucleic acid molecules that hybridize to the polynucleotides of the present invention at lower stringency hybridization conditions. Changes in the stringency of hybridization and signal detection are primarily accomplished through the manipulation of formamide concentration (lower percentages of formamide result in lowered stringency); salt conditions, or temperature. For example, lower stringency conditions include an overnight incubation at 37 degree C. in a solution comprising 6×SSPE (20×SSPE=3M NaCl; 0.2M NaH$_2$PO$_4$; 0.02M EDTA, pH 7.4), 0.5% SDS, 30% formamide, 100 µg/ml salmon sperm blocking DNA; followed by washes at 50 degree C. with 1×SSPE, 0.1% SDS.

In addition, to achieve even lower stringency, washes performed following stringent hybridization can be done at higher salt concentrations (e.g. 5×SSC).

Note that variations in the above conditions may be accomplished through the inclusion and/or substitution of alternate blocking reagents used to suppress background in hybridization experiments. Typical blocking reagents include Denhardt's reagent, BLOTTO, heparin, denatured salmon sperm DNA, and commercially available proprietary formulations. The inclusion of specific blocking reagents may require modification of the hybridization conditions described above, due to problems with compatibility.

Of course, a polynucleotide which hybridizes only to polyA+ sequences (such as any 3' terminal polyA+ tract of a cDNA shown in the sequence listing), or to a complementary stretch of T (or U) residues, would not be included in the definition of "polynucleotide," since such a polynucleotide would hybridize to any nucleic acid molecule containing a poly (A) stretch or the complement thereof (e.g., practically any double-stranded cDNA clone generated using oligo dT as a primer).

The polynucleotides of the present invention can be composed of any polyribonucleotide or polydeoxyribonucleotide, which may be unmodified RNA or DNA or modified RNA or DNA. For example, polynucleotides can be composed of single- and double-stranded DNA, DNA that is a mixture of single- and double-stranded regions, single- and double-stranded RNA, and RNA that is mixture of single- and double-stranded regions, hybrid molecules comprising DNA and RNA that may be single-stranded or, more typically, double-stranded or a mixture of single- and double-stranded regions. In addition, the polynucleotide can be composed of triple-stranded regions comprising RNA or DNA or both RNA and DNA. A polynucleotide may also contain one or more modified bases or DNA or RNA backbones modified for stability or for other reasons. "Modified" bases include, for example, tritylated bases and unusual bases such as inosine. A variety of modifications can be made to DNA and RNA; thus, "polynucleotide" embraces chemically, enzymatically, or metabolically modified forms.

In specific embodiments, the polynucleotides of the invention are at least 15, at least 30, at least 50, at least 100, at least 125, at least 500, or at least 1000 continuous nucleotides but are less than or equal to 300 kb, 200 kb, 100 kb, 50 kb, 15 kb, 10 kb, 7.5 kb, 5 kb, 2.5 kb, 2.0 kb, or 1 kb, in length. In a further embodiment, polynucleotides of the invention comprise a portion of the coding sequences, as disclosed herein, but do not comprise all or a portion of any intron. In another embodiment, the polynucleotides comprising coding sequences do not contain coding sequences of a genomic flanking gene (i.e., 5' or 3' to the gene of interest in the genome). In other embodiments, the polynucleotides of the invention do not contain the coding sequence of more than 1000, 500, 250, 100, 50, 25, 20, 15, 10, 5, 4, 3, 2, or 1 genomic flanking gene(s).

"SEQ ID NO:X" refers to a polynucleotide sequence described in column 5 of Table 1A, while "SEQ ID NO:Y" refers to a polypeptide sequence described in column 11 of Table 1A. SEQ ID NO:X is identified by an integer specified in column 5 of Table 1A. The polypeptide sequence SEQ ID NO:Y is a translated open reading frame (ORF) encoded by polynucleotide SEQ ID NO:X. The polynucleotide sequences are shown in the sequence listing immediately followed by all of the polypeptide sequences. Thus, a polypeptide sequence corresponding to polynucleotide sequence SEQ ID NO:11 is the first polypeptide sequence shown in the sequence listing. The second polypeptide sequence corresponds to the polynucleotide sequence shown as SEQ ID NO:12, and so on.

The polypeptides of the present invention can be composed of amino acids joined to each other by peptide bonds or modified peptide bonds, i.e., peptide isosteres, and may contain amino acids other than the 20 gene-encoded amino acids. The polypeptides may be modified by either natural processes, such as posttranslational processing, or by chemical modification techniques which are well known in the art. Such modifications are well described in basic texts and in more detailed monographs, as well as in a voluminous research literature. Modifications can occur anywhere in a polypeptide, including the peptide backbone, the amino acid side-chains and the amino or carboxyl termini. It will be appreciated that the same type of modification may be present in the same or varying degrees at several sites in a given polypeptide. Also, a given polypeptide may contain many types of modifications. Polypeptides may be branched, for example, as a result of ubiquitination, and they may be cyclic, with or without branching. Cyclic, branched, and branched cyclic polypeptides may result from posttranslation natural processes or may be made by synthetic methods. Modifications include acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent cross-links, formation of cysteine, formation of pyroglutamate, formylation, gamma-carboxylation, glycosylation, GPI anchor formation, hydroxylation, iodination, methylation, myristoylation, oxidation, pegylation, proteolytic processing, phosphorylation, prenylation, racemization, selenoylation, sulfation, transfer-RNA mediated addition of amino acids to proteins such as arginylation, and ubiquitination. (See, for instance, PROTEINS—STRUCTURE AND MOLECULAR PROPERTIES, 2nd Ed., T. E. Creighton, W. H. Freeman and Company, New York (1993); POSTTRANSLATIONAL COVALENT MODIFICATION OF PROTEINS, B. C. Johnson, Ed., Academic Press, New York, pgs. 1-12 (1983); Seifter et al., Meth Enzymol 182:626-646 (1990); Rattan et al., Ann NY Acad Sci 663:48-62 (1992)).

The polypeptides of the invention can be prepared in any suitable manner. Such polypeptides include isolated naturally occurring polypeptides, recombinantly produced polypeptides, synthetically produced polypeptides, or polypeptides produced by a combination of these methods. Means for preparing such polypeptides are well understood in the art.

The polypeptides may be in the form of the secreted protein, including the mature form, or may be a part of a larger protein, such as a fusion protein (see below). It is often advantageous to include an additional amino acid sequence which contains secretory or leader sequences, pro-sequences, sequences which aid in purification, such as multiple histidine residues, or an additional sequence for stability during recombinant production.

The polypeptides of the present invention are preferably provided in an isolated form, and preferably are substantially purified. A recombinantly produced version of a polypeptide, including the secreted polypeptide, can be substantially purified using techniques described herein or otherwise known in the art, such as, for example, by the one-step method described in Smith and Johnson, Gene 67:31-40 (1988). Polypeptides of the invention also can be purified from natural, synthetic or recombinant sources using techniques described herein or otherwise known in the art, such as, for example, antibodies of the invention raised against the polypeptides of the present invention in methods which are well known in the art.

By a polypeptide demonstrating a "functional activity" is meant, a polypeptide capable of displaying one or more known functional activities associated with a full-length (complete) protein of the invention. Such functional activities include, but are not limited to, biological activity, antigenicity [ability to bind (or compete with a polypeptide for binding) to an anti-polypeptide antibody], immunogenicity (ability to generate antibody which binds to a specific polypeptide of the invention), ability to form multimers with polypeptides of the invention, and ability to bind to a receptor or ligand for a polypeptide.

"A polypeptide having functional activity" refers to polypeptides exhibiting activity similar, but not necessarily identical to, an activity of a polypeptide of the present invention, including mature forms, as measured in a particular assay, such as, for example, a biological assay, with or without dose dependency. In the case where dose dependency does exist, it need not be identical to that of the polypeptide, but rather substantially similar to the dose-dependence in a given activity as compared to the polypeptide of the present invention (i.e., the candidate polypeptide will exhibit greater activity or not more than about 25-fold less and, preferably, not more than about tenfold less activity, and most preferably, not more than about three-fold less activity relative to the polypeptide of the present invention).

The functional activity of the polypeptides, and fragments, variants derivatives, and analogs thereof, can be assayed by various methods.

For example, in one embodiment where one is assaying for the ability to bind or compete with full-length polypeptide of the present invention for binding to an antibody to the full length polypeptide, various immunoassays known in the art can be used, including but not limited to, competitive and non-competitive assay systems using techniques such as radioimmunoassays, ELISA (enzyme linked immunosorbent assay), "sandwich" immunoassays, immunoradiometric assays, gel diffusion precipitation reactions, immunodiffusion assays, in situ immunoassays (using colloidal gold, enzyme or radioisotope labels, for example), western blots, precipitation reactions, agglutination assays (e.g., gel agglutination assays, hemagglutination assays), complement fixation assays, immunofluorescence assays, protein A assays, and immunoelectrophoresis assays, etc. In one embodiment, antibody binding is detected by detecting a label on the primary antibody. In another embodiment, the primary antibody is detected by detecting binding of a secondary antibody or reagent to the primary antibody. In a further embodiment, the secondary antibody is labeled. Many means are known in the art for detecting binding in an immunoassay and are within the scope of the present invention.

In another embodiment, where a ligand is identified, or the ability of a polypeptide fragment, variant or derivative of the invention to multimerize is being evaluated, binding can be assayed, e.g., by means well-known in the art, such as, for example, reducing and non-reducing gel chromatography, protein affinity chromatography, and affinity blotting. See generally, Phizicky, E., et al., Microbiol. Rev. 59:94-123 (1995). In another embodiment, physiological correlates polypeptide of the present invention binding to its substrates (signal transduction) can be assayed.

In addition, assays described herein (see Examples) and otherwise known in the art may routinely be applied to measure the ability of polypeptides of the present invention and fragments, variants derivatives and analogs thereof to elicit polypeptide related biological activity (either in vitro or in vivo). Other methods will be known to the skilled artisan and are within the scope of the invention.

Polynucleotides and Polypeptides of the Invention

Features of Protein Encoded by Gene No: 1

In specific embodiments, polypeptides of the invention comprise, or alternatively consists of, the following amino acid sequence: TRPEKVQAPLK WFKFQILDPP (SEQ ID NO: 257). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding this polypeptide are encompassed by the invention. Antibodies that bind polypeptides of the invention are also encompassed by the invention. Polynucleotides encoding said polypeptide are also encompassed by the invention.

This gene is expressed in dendritic cells and to a lesser extent in other tissues.

Polynucleotides and polypeptides of the invention are useful as reagents for differential identification of the tissue(s) or cell type(s) present in a biological sample and for diagnosis of diseases and conditions which include, but are not limited to, immune, nervous system, and inflammatory disorders. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., immune, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in dendritic cells indicates that polynucleotides and polypeptides corresponding to this gene are useful for the detection/treatment of neurodegenerative disease states and behavioural disorders such as Alzheimer's Disease, Parkinson's Disease, Huntington's Disease, schizophrenia, mania, dementia, paranoia, obsessive compulsive disorder, panic disorder, and autism. In addition, the gene or gene product may also play a role in the treatment and/or detection of developmental disorders associated with the developing embryo, sexually-linked disorders, or disorders of the cardiovascular system. Furthermore, expression of this gene product in primary dendritic cells also indicates that it may play a role in mediating responses to infection and controlling immunological responses, such as those that occur during immune surveillance. Representative uses are described in the "Immune Activity" and "Infectious Disease" sections below, in Example 11, 13, 14, 16, 18, 19, 20, 32, 33, 34, 53, and 58, and elsewhere herein.

Furthermore, the protein may also be used to determine biological activity, raise antibodies, as tissue markers, to isolate cognate ligands or receptors, to identify agents that modulate their interactions, in addition to its use as a nutritional supplement. Protein, as well as, antibodies directed against the protein may show utility as a tumor marker.

Features of Protein Encoded by Gene No: 2

The translation product of this gene share homology with the Tbcl gene of *Mus musculus* which is thought to play a role in the cell cycle and differentiation of various tissues (See Genbank accession no. gi1988221 as well as Medline article no.96032578; all references available through these accessions are hereby incorporated by reference herein).

In specific embodiments, polypeptides of the invention comprise, or alternatively consist of, an amino acid sequence selected from the group:

SAEFGVAPLPGRRGSPVRQLAQFRRRLL-
RGSGGRGAPGRPPRCPGEARVMXPPS-
CIQDEPFPHPLEPEPGVS AQPGPGKPSDKRFRLW-
YVGGSCLDHRTTLPMLPWLMAEIRRRSQKPEAGGC-
GAPAAREVILVLSAPFLRCV PAPGAGASGGTSP-
SATQPNPAVFIFEHKAQHISRFIHNSHDLTYFAYL
IKAQPDDPESQMACHVFRATDPS VPDVISSIRQLSKX-
AMKEDAKPSKDNEDAFYNSQKFEVL-
YCGKVTVTPQEGPLKPHR (SEQ ID NO: 258), PMLP-
WLMAEIRRRS (SEQ ID NO: 259), IHNSHDLTYFAY-
LIKAQPD (SEQ ID NO: 260), KFEVLYCGKVTV (SEQ ID NO: 261), and/or ISSIRQLSKAMKE (SEQ ID NO: 262). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding said polypeptides are also encompassed by the invention.

This gene is expressed in smooth muscle and dendritic cells and to a lesser extent in other tissues.

Polynucleotides and polypeptides of the invention are useful as reagents for differential identification of the tissue(s) or cell type(s) present in a biological sample and for diagnosis of diseases and conditions which include, but are not limited to, cardiovascular diseases and immune and inflammatory disorders. Similarly, polypeptides and antibodies directed to these polypeptides are useful in providing immunological probes for differential identification of the tissue(s) or cell type(s). For a number of disorders of the above tissues or cells, particularly of the immune system and cardiovascular system, expression of this gene at significantly higher or lower levels may be routinely detected in certain tissues or cell types (e.g., smooth muscle and dendritic cells, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in smooth muscle and dendritic cells and homology to a protein involved in regulation of cell cycle and tissue differentiation indicates that polynucleotides and polypeptides corresponding to this gene are useful for the detection/treatment and/or prevention of immune system disorders, cardiovascular disorders or diseases, including cancer and other proliferative disorders.

The tissue distribution indicates polynucleotides and polypeptides corresponding to this gene are useful for the diagnosis and treatment of a variety of immune system disorders. Representative uses are described in the "Immune Activity" and "Infectious Disease" sections below, in Example 11, 13, 14, 16, 18, 19, 20, 32, 33, 34, 53, and 58, and elsewhere herein. Briefly, the expression of this gene product indicates a role in regulating the proliferation; survival; differentiation; and/or activation of hematopoietic cell lineages, including blood stem cells.

This gene product may be involved in the regulation of cytokine production, antigen presentation, or other processes suggests a usefulness in the treatment of cancer (e.g., by boosting immune responses). Expression in cells of lymphoid origin, the natural gene product may be involved in immune functions. Therefore it may be also used as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersensitivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus erythematosis, drug induced hemolytic anemia, rheumatoid arthritis, Sjogren's disease, scleroderma and tissues.

Moreover, the protein may represent a secreted factor that influences the differentiation or behavior of other blood cells, or that recruits hematopoietic cells to sites of injury. In addition, this gene product may have commercial utility in the expansion of stem cells and committed progenitors of various blood lineages, and in the differentiation and/or proliferation of various cell types. Alternatively, the protein is useful in the detection, treatment, and/or prevention of vascular conditions, which include, but are not limited to, microvascular disease, vascular leak syndrome, aneurysm, stroke, atherosclerosis, arteriosclerosis, or embolism. For example, this gene product may represent a soluble factor produced by smooth muscle that regulates the innervation of organs or regulates the survival of neighboring neurons. Likewise, it may be involved in controlling the digestive process, and such actions as peristalsis. Similarly, it may be involved in controlling the vasculature in areas where smooth muscle surrounds the endothelium of blood vessels.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 3

The translation product of this gene shares sequence homology with alpha-1 antitrypsin (See Genebank accession no. gn1|PID|d1021080 and BAA20264; all references available through this accession are hereby incorporated by reference herein). Alpha-1-antitrypsin is an important plasma protease inhibitor affecting a wide variety of serine proteases involved in coagulation, fibrinolysis and kinen generation.

In specific embodiments, polypeptides of the invention comprise, or alternatively consists of, the following amino acid sequence: GERRNWGGEVYYSTGYSSRK (SEQ ID NO: 263). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding this polypeptide are encompassed by the invention. Antibodies that bind polypeptides of the invention are also encompassed by the invention. Polynucleotides encoding said polypeptides are also encompassed by the invention.

The polypeptide of this gene has been determined to have a transmembrane domain at about amino acid position 22-414 of the amino acid sequence referenced in Table 1A for this gene. Moreover, a cytoplasmic tail encompassing amino acids 5-21 of this protein has also been determined. Based upon these characteristics, it is believed that the protein product of this gene shares structural features to type Ib membrane proteins.

This gene is expressed in healing groin wound and to a lesser extent in some other tissues.

Polynucleotides and polypeptides of the invention are useful as reagents for differential identification of the tissue(s) or cell type(s) present in a biological sample and for diagnosis of diseases and conditions which include, but are not limited to, wound healing disorders. Similarly, polypeptides and antibodies directed to these polypeptides are useful in providing immunological probes for differential identification of the tissue(s) or cell type(s). For a number of disorders of the above tissues or cells, particularly of the healing groin wound, expression of this gene at significantly higher or lower levels may be routinely detected in certain tissues or cell types (e.g., healing, regenerative, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist of, one or more immunogenic epitopes shown in SEQ ID NO: 136 as residues: Phe-25 to Tyr-30, Gln-37 to Arg-42, Lys-106 to Leu-112, Leu-123 to Leu-130, Gln-142 to Phe-150, Gln-183 to Lys-188, Asp-219 to Glu-226, Lys-359 to Glu-366. Polynucleotides encoding said polypeptides are also encompassed by the invention.

The tissue distribution in healing groin wound and homology to alpha-1 antitrypsin indicates that polynucleotides and polypeptides corresponding to this gene are useful for diagnosis and therapeutic treatment of wound healing disorders. In addition, since healing wounds have transcriptional environments similar to developing tissues, the translation product of this gene may be useful for the diagnosis and treatment of cancer and other proliferative disorders.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 4

The translation product of this gene shares homology with members of the HEMK family of modification methylases (See, e.g., Genbank Accession No. gb|AAD26417.1|AF131220_1; all references available through this accession are hereby incorporated by reference herein).

Preferred polypeptides of the invention comprise, or alternatively consist of, an amino acid sequence selected from the group:

EPGAAQESW (SEQ ID NO: 264), LCARPSCSYTGAEN-QGQPRSPGWGSSHVGWGWGVGSPFLG-SQEWSGLAPDLPDQEEEQPVGRHSCPDMS QCIKRGHQPVGFSKHAWRCLVGCCP-WEEEKRSCHPFGAXLLWVLRFALQPX-VYEDPAALDGGEEGMDIX THILALAPRLLKDSGSI-FLEVDPRHPXLVSSWLQSRPDLYLNLVAVRRDFCGRP-RFLHIRRSGP (SEQ ID NO: 265), LCARPSCSYTGAEN-QGQPRSPGWGSSHVGWGWGVGSP (SEQ ID NO: 266), FLGSQEWSGLAPDLPDQEE-EQPVGRHSCPDMSQCIKR (SEQ ID NO: 267), GHQPVGFSKHAWRCLVGCCP-WEEEKRSCHPFGAXLLW (SEQ ID NO: 268), VLR-FALQPXVYEDPAALDGGEEGMDIXTHILALAPRL (SEQ ID NO: 269), and/or LKDSGSIFLEVDPRHPXLVSS-WLQSRPDLYLNLVAVRRDFCGRPRFLHIRRSGP (SEQ ID NO: 270). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

This gene is expressed in immune (e.g., B-cells and neutrophils) and tumor tissues, and to a lesser extent in some other tissues such as heart.

Polynucleotides and polypeptides of the invention are useful as reagents for differential identification of the tissue(s) or cell type(s) present in a biological sample and for diagnosis of diseases and conditions which include, but are not limited to, immune and inflammatory disorders and tumorigenesis Similarly, polypeptides and antibodies directed to these polypeptides are useful in providing immunological probes for differential identification of the tissue(s) or cell type(s). For a number of disorders of the above tissues or cells, particularly of the immune and tumor tissues, expression of this gene at significantly higher or lower levels may be routinely detected in certain tissues or cell types (e.g., cancerous and wounded tissues) or bodily fluids (e.g., serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist of, one or more immunogenic epitopes shown in SEQ ID NO: 137 as residues: Met-1 to Cys-6, Ser-26 to Gly-35. Polynucleotides encoding said polypeptides are also encompassed by the invention.

The tissue distribution in tumors of immune origins indicates that polynucleotides and polypeptides corresponding to this gene are useful for diagnosis and intervention of such tumors, in addition to other tumors where expression has been indicated. Additionally, this gene is a good target for antagonists, particularly small molecules or antibodies, which block binding of the receptor by its cognate ligand(s).

The tissue distribution in neutrophils and B-cells indicates polynucleotides and polypeptides corresponding to this gene are useful for the diagnosis and treatment of a variety of immune system disorders. Representative uses are described in the "Immune Activity" and "Infectious Disease" sections below, in Example 11, 13, 14, 16, 18, 19, 20, 32, 33, 34, 53, and 58, and elsewhere herein. Briefly, the expression indicates a role in regulating the proliferation; survival; differentiation; and/or activation of hematopoietic cell lineages, including blood stem cells. Involvement in the regulation of cytokine production, antigen presentation, or other processes indicates a usefulness for treatment of cancer (e.g. by boosting immune responses). Expression in cells of lymphoid origin, indicates the natural gene product would be involved in immune functions. Therefore it would also be useful as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersensitivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus erythematosis, drug induced hemolytic anemia, rheumatoid arthritis, Sjogren's disease, and scleroderma.

Moreover, the protein may represent a secreted factor that influences the differentiation or behavior of other blood cells, or that recruits hematopoietic cells to sites of injury. Thus, this gene product is thought to be useful in the expansion of stem cells and committed progenitors of various blood lineages, and in the differentiation and/or proliferation of various cell types.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 5

The translation product of this gene shares sequence homology with mouse von Ebner minor salivary gland protein which may play a role in carbohydrate metabolism (See Genebank Accession No. gb|AAA87581.1|; all references available through this accession are hereby incorporated by reference herein).

Preferred polypeptides of the invention comprise, or alternatively consist of, an amino acid sequence selected from the group:

QELLVKIPLDMVAGFNTPL (SEQ ID NO: 271), LRIQLL-HKLSFLVNALAKQVMNLLVP (SEQ ID NO: 272), AGP-WTFTLLCGLLAATLIQATLSPTAVLILG-PKVIKEKLTQELKDHNATSILQQLPLL (SEQ ID NO: 274), and/or HXIWLKVITXNILQLQVKPS (SEQ ID NO: 273). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

This gene is expressed in respiratory tissues such as trachea, larynx and other pulmonary tissues, and to a lesser extent in other tissues.

Polynucleotides and polypeptides of the invention are useful as reagents for differential identification of the tissue(s) or cell type(s) present in a biological sample and for diagnosis of diseases and conditions which include, but are not limited to, respiratory system and oral disorders Similarly, polypeptides and antibodies directed to these polypeptides are useful in providing immunological probes for differential identification of the tissue(s) or cell type(s). For a number of disorders of the above tissues or cells, particularly of the respiratory tissues, expression of this gene at significantly higher or lower levels may be routinely detected in certain tissues or cell types (e.g., cancerous and wounded tissues) or bodily fluids (e.g., serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 138 as residues: Lys-39 to Asn-48, Arg-63 to Gly-68, Pro-101 to Gln-106. Polynucleotides encoding said polypeptides are also encompassed by the invention.

The tissue distribution combined with the homology to von Ebner minor salivary gland protein indicates that polynucleotides and polypeptides corresponding to this gene are useful for diagnosis and treatment of respiratory and oral diseases.

Furthermore, the tissue distribution in pulmonary tissues also indicates that polynucleotides and polypeptides corresponding to this gene are useful for diagnosis and intervention of tumors within these tissues, in addition to other tumors where expression has been indicated. Protein, as well as, antibodies directed against the protein may show utility as a tumor marker and/or immunotherapy targets for the above listed tumors and tissues. Protein may show utility in the diagnosis, treatment, and/or prevention of disorders in carbohydrate metabolism.

Features of Protein Encoded by Gene No: 6

The gene encoding the disclosed cDNA is believed to reside on chromosome 2. Accordingly, polynucleotides related to this invention are useful as a marker in linkage analysis for chromosome 2.

This gene is expressed in fast-growing tissues such as fetal tissues, hematopoietic cells and tumor tissues and to a lesser extent in other tissues.

Polynucleotides and polypeptides of the invention are useful as reagents for differential identification of the tissue(s) or cell type(s) present in a biological sample and for diagnosis of diseases and conditions which include, but are not limited to, growth disorders, tumorigenesis, and immune or inflammatory disorders Similarly, polypeptides and antibodies directed to these polypeptides are useful in providing immunological probes for differential identification of the tissue(s) or cell type(s). For a number of disorders of the above tissues or cells, particularly of the fast-growing tissues such as fetal tissues, hematopoietic cells and tumor tissues, expression of this gene at significantly higher or lower levels may be routinely detected in certain tissues or cell types (e.g., cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in fast growing tissues indicates that polynucleotides and polypeptides corresponding to this gene are useful for the diagnosis and treatment of cancer and other proliferative disorders.

Expression in embryonic tissue and other cellular sources marked by proliferating cells indicates that this protein may play a role in the regulation or cellular division. Additionally, the expression in hematopoietic cells and tissues indicates that this protein may play a role in the proliferation, differentiation, and/or survival of hematopoietic cell lineages which implicates the protein product of this gene as being useful for the treatment and diagnosis of hematopoetic related disorders such as anemia, pancytopenia, leukopenia, thrombocytopenia or leukemia since stromal cells are important in the production of cells of hematopoietic lineages. Representative uses are described in the "Immune Activity" and "Infectious Disease" sections below, in Example 11, 13, 14, 16, 18, 19, 20, 32, 33, 34, 53, and 58, and elsewhere herein. Briefly, the uses include bone marrow cell ex vivo culture, bone marrow transplantation, bone marrow reconstitution, radiotherapy or chemotherapy of neoplasia.

The gene product may also be involved in lymphopoiesis, therefore, it can be used in immune disorders such as infection, inflammation, allergy, immunodeficiency etc. Thus, this gene may be useful in the treatment of lymphoproliferative disorders, and in the maintenance and differentiation of various hematopoietic lineages from early hematopoietic stem and committed progenitor cells.

Features of Protein Encoded by Gene No: 7

The translation product of this gene shares sequence homology with mitochondrial NADH-Ubiquinone oxidoreductase, chain 2.

Preferred polypeptides of the invention comprise, or alternatively consist of, an amino acid sequence selected from the group:

HFIITLTTFFTNYFL (SEQ ID NO: 275), and/or MKIT-FQDLFPMWNSFKCFLHGNVFSLFVLF-PLLTCFSFPYTVNSG TKLDWVGWLVGWFFLEFMY-INKGFEVTSENNISKRVLVRENIRIKSSPERVLRM (SEQ ID NO: 276). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

This gene is expressed in stromal cells (cell code TF274), induced epithelial cells and human cerebellum.

Polynucleotides and polypeptides of the invention are useful as reagents for differential identification of the tissue(s) or cell type(s) present in a biological sample and for diagnosis of diseases and conditions which include, but are not limited to, metabolic disorders and conditions Similarly, polypeptides and antibodies directed to these polypeptides are useful in providing immunological probes for differential identification of the tissue(s) or cell type(s). For a number of disorders of the above tissues or cells, particularly of the liver, brain, and integument, expression of this gene at significantly higher or lower levels may be routinely detected in certain tissues or cell types (e.g., cancerous and wounded tissues) or bodily fluids (e.g., lymph, bile, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in epithelial and cerebral tissues combined with the homology to a known mitochondrial NADH-Ubiquinone oxidoreductase gene indicates that polynucleotides and polypeptides corresponding to this gene are useful for the diagnosis, prevention, and/or treatment of various metabolic disorders such as Tay-Sach's disease, phenylkenonuria, galactosemia, porphyrias, and Hurler's syndrome. Additionally, the tissue distribution indicates that polynucleotides and polypeptides corresponding to this gene are useful for the treatment and diagnosis of hematopoietic related disorders such as anemia, pancytopenia, leukopenia, thrombocytopenia or leukemia, since stromal cells are important in the production of cells of hematopoietic lineages.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 8

The translation product of this gene shares sequence homology with Platelet activating factor acetylhydrolase which inactivates Platelet activating factor, a potent phospholipid mediator affecting various physiological processes (See, e.g., Genbank Accession Nos. gi|349824|gb|AAA02880.1| and gi|2072303|gb|AAC04610.1|; all references available through this accession are hereby incorporated by reference herein).

Preferred polypeptides of the invention comprise, or alternatively consist of, an amino acid sequence selected from the group: RFWGSYEPHFSQEVSVIPP (SEQ ID NO: 277), and/or IRGNYFSGRKKSSSDTPKGSKDKIS-VWNRSQXACIRICKV HPNYIQIYLWHSATSF (SEQ ID NO: 278). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

This gene is expressed in CD34 depleted buffy coat (cord blood) and to a lesser extent in human prostate cancer, stage 3 fraction.

Polynucleotides and polypeptides of the invention are useful as reagents for differential identification of the tissue(s) or cell type(s) present in a biological sample and for diagnosis of diseases and conditions which include, but are not limited to, cancer, particularly of the prostate Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., prostate, cancerous and wounded tissues) or bodily fluids (e.g., lymph, cord blood, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in CD34 depleted buffy coat combined with the homology to Platelet-activating factor acetylhydrolases, proteins involved in regulation of platelet activity, indicates that polynucleotides and polypeptides corresponding to this gene are useful for the diagnosis and treatment of a variety of immune system disorders. Expression of this gene product in hematopoietic cells indicates a role in the regulation of the proliferation; survival; differentiation; and/or activation of potentially all hematopoietic cell lineages, including blood stem cells. Representative uses are described in the "Immune Activity" and "Infectious Disease" sections below, in Example 11, 13, 14, 16, 18, 19, 20, 32, 33, 34, 53, and 58, and elsewhere herein.

This gene product may be involved in the regulation of cytokine production, antigen presentation, or other processes that may also suggest a usefulness in the treatment of cancer e.g. by boosting immune responses. Expression in cells of lymphoid origin, the natural gene product may be involved in immune functions. Therefore it may be also used as an agent for immunological disorders including arthritis, asthma, immune deficiency diseases such as AIDS, and leukemia.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 9

In specific embodiments, polypeptides of the invention comprise, or alternatively consist of, the following amino acid sequence:

AGNQVEPFHVSLPSCLSPLPHLGH-SMGVPSPTAWPSLASFHTQKKAR-IRQEEESPPLPSPQELAFSALRV FFRV (SEQ ID NO: 279). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridize, under stringent conditions, to the polynucleotide encoding this polypeptide are encompassed by the invention. Antibodies that bind polypeptides of the invention are also encompassed by the invention. Polynucleotides encoding said polypeptides are also encompassed by the invention.

This gene is expressed in primary dendritic cells.

Polynucleotides and polypeptides of the invention are useful as reagents for differential identification of the tissue(s) or cell type(s) present in a biological sample and for diagnosis of diseases and conditions which include, but are not limited to, immunosuppression and cancer. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., immune, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 142 as residues: Arg-20 to Lys-44, Arg-59 to Arg-68, Trp-74 to Lys-86, Thr-91 to Val-102. Polynucleotides encoding said polypeptides are also encompassed by the invention.

The tissue distribution in primary dendritic cells indicates that polynucleotides and polypeptides corresponding to this gene are useful for the diagnosis and treatment of a variety of immune system disorders. Expression of this gene product in dendritic cells indicates a role in the regulation of the proliferation; survival; differentiation; and/or activation of potentially all hematopoietic cell lineages, including blood stem cells. Representative uses are described in the "Immune Activity" and "Infectious Disease" sections below, in Example 11, 13, 14, 16, 18, 19, 20, 32, 33, 34, 53, and 58, and elsewhere herein. Briefly, the uses include bone marrow cell ex-vivo culture, bone marrow transplantation, bone marrow reconstitution, radiotherapy or chemotherapy of neoplasia.

This gene product may be involved in the regulation of cytokine production, antigen presentation, or other processes that may also suggest a usefulness in the treatment of cancer e.g. by boosting immune responses. Expression in cells of lymphoid origin, the natural gene product may be involved in immune functions. Therefore it may be also used as an agent for immunological disorders including arthritis, asthma, immune deficiency diseases such as AIDS, and leukemia.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 10

The translation product of this gene shares sequence homology with peptide/histidine transporter from *Rattus norvegicus* and other peptide transporters which are thought to be important in transporting amino acids and peptides into cells (See, e.g., Genbank Accession No. gb|AAD24570.1|AF121080_1; all references available through this accession are hereby incorporated by reference herein).

In specific embodiments, polypeptides of the invention comprise, or alternatively consist of, the following amino acid sequence: FIQQNISFLLGYSIP VGCVGLAFFIFLFATPVFITKPP (SEQ ID NO: 280). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridize, under stringent conditions, to the polynucleotide encoding this polypeptide are encompassed by the invention. Antibodies that bind polypeptides of the invention are also encompassed by the invention. Polynucleotides encoding said polypeptides are also encompassed by the invention.

The gene encoding the disclosed cDNA is believed to reside on chromosome 11. Accordingly, polynucleotides related to this invention are useful as a marker in linkage analysis for chromosome 11.

This gene is expressed in macrophages and to a lesser extent in other immune cells including primary dendritic cells, neutrophils, resting T-cells, B cell lymphomas) and lung and fetal liver spleen.

Polynucleotides and polypeptides of the invention are useful as reagents for differential identification of the tissue(s) or cell type(s) present in a biological sample and for diagnosis of diseases and conditions which include, but are not limited to, cancer and disorders, particularly of the immune and hematopoietic systems. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., immune, hematopoietic, and/or other tissues) or bodily fluids (e.g., lymph, serum, plasma, urine, synovial fluid and spinal fluid)

or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 143 as residues: Arg-23 to Gln-30, Asp-37 to Asp-50, Glu-230 to Met-235, Pro-271 to Arg-281, Arg-306 to Ser-316, Ser-318 to Gly-325. Polynucleotides encoding said polypeptides are also encompassed by the invention.

The tissue distribution in macrophages and other immune cells indicates that polynucleotides and polypeptides corresponding to this gene are useful for the diagnosis and treatment of cancer and other proliferative disorders. This gene product may be involved in the regulation of cytokine production, antigen presentation, or other processes suggests a usefulness in the treatment of cancer (e.g., by boosting immune responses). Alternatively expression within embryonic tissue and other cellular sources marked by proliferating cells indicates that this protein may play a role in the regulation or cellular division. Additionally, the expression in hematopoietic cells and tissues indicates that this protein may play a role in the proliferation, differentiation, and/or survival of hematopoietic cell lineages. Representative uses are described in the "Immune Activity" and "Infectious Disease" sections below, in Example 11, 13, 14, 16, 18, 19, 20, 32, 33, 34, 53, and 58, and elsewhere herein. In such an event, this gene may be useful in the treatment of lymphoproliferative disorders, and in the maintenance and differentiation of various hematopoietic lineages from early hematopoietic stem and committed progenitor cells. Similarly, embryonic development also involves decisions involving cell differentiation and/or apoptosis in pattern formation. Thus this protein may also be involved in apoptosis or tissue differentiation and could again be useful in cancer therapy.

Furthermore, the protein may also be used to determine biological activity, raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 11

The translation product of this gene shares sequence homology with procollagen-proline dioxygenase, an apparently secreted protein which is thought to be important in the formation of 4-hydroxyproline in collagens (See, e.g., Genbank Accession No. pir|A33832|DACHA; all references available through this accession are hereby incorporated by reference herein). Furthermore, the translation product has an EF-hand domain (Prosite PS00018) which is a calcium binding domain as found in calmodulin, calpain, spectrin alpha chain, etc., (See, e.g. GeneSeq Accession No.R78523; all references available through this accession are hereby incorporated by reference herein).

Preferred polypeptides of the invention comprise, or alternatively consist of, an amino acid sequence selected from the group: VSAHHPSGADEGVTAX QILPTEEYEEAMSTM-QVSQLDLFRLLDQNRDGHLQLREV-LAQTRLGNGWWMTPESIQEMYAAIKADPDGD GVLSLQEFSNMDLRDFHKYMRSHKAES-SELVRNSHHTWLYQGEGAHHIMRAI-RQRVLRLTRLSPEIVELSE PLQVVRYGEGGHYHAH-VDSGPVYPETICSHTKLVANESVPFETSCRYMTVLFY-LNNVTGGGETVFPVADN RTYDEMSLIQDDVDL-RDTRRHCDKGNLRVKPQQGTAVFWY-NYLPDGQGWVGDVDDYSLHGGCLVTRGT KWIAN-NWINVDPSRARQALFQQEMARLAREGGTDSQPEWA-LDRAXXDARVEL (SEQ ID NO: 281), AVFWYN (SEQ ID NO: 282), TVLFYLNNVTGGGETVFP (SEQ ID NO: 283), DLFRLLDQN RDGHLQLREVLAQTRLGNGWWMTPE-SIQEMYAAIKADPDGDGVLSLQEFS (SEQ ID NO: 284), VSAHHPSGADEGVTAXQILPTEEYEEAM-STMQVSQLDL (SEQ ID NO: 285), FRLLDQN-RDGHLQLREVLAQTRLGNGWWMTPESIQEMY (SEQ ID NO: 286), AAIKADPDGDGVLSLQEFSNMDLRDFH-KYMRSHKAESS (SEQ ID NO: 287), ELVRNSHHTW-LYQGEGAHHIMRAIRQRVLRLTRLSPEI (SEQ ID NO: 288), VELSEPLQVVRYGEGGHYHAHVDSGPVY-PETICSHTKL (SEQ ID NO: 289), VANES-VPFETSCRYMTVLFYLNNVTGGGETVFPVADNR (SEQ ID NO: 290), TYDEMSLIQDDVDLRDTRRHCD-KGNLRVKPQQGTAVFW (SEQ ID NO: 291), YNYLP-DGQGWVGDVDDYSLHGGCLVTRGTKWIANNWIN (SEQ ID NO: 292), and/or VDPSRARQALFQQEMAR-LAREGGTDSQPEWA LDRAXXDARVEL (SEQ ID NO: 293). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridize, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

The gene encoding the disclosed cDNA is believed to reside on chromosome 3. Accordingly, polynucleotides related to this invention are useful as a marker in linkage analysis for chromosome 3.

This gene is expressed in human endometrial tumor and to a lesser extent in brain, as well as a variety of other normal and cancerous tissues.

Polynucleotides and polypeptides of the invention are useful as reagents for differential identification of the tissue(s) or cell type(s) present in a biological sample and for diagnosis of diseases and conditions which include, but are not limited to, endometrial cancer, in addition to other proliferative disorders. Similarly, polypeptides and antibodies directed to these polypeptides are useful in providing immunological probes for differential identification of the tissue(s) or cell type(s). For a number of disorders of the above tissues or cells, particularly of the reproductive and neural systems, expression of this gene at significantly higher or lower levels may be routinely detected in certain tissues or cell types (e.g., neural, reproductive, and/or other tissues) or bodily fluids (e.g., lymph, amniotic fluid, serum, plasma, urine, synovial fluid and spinal fluid, lymph) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 144 as residues: Ser-21 to His-33, Ala-35 to Thr-43. Polynucleotides encoding said polypeptides are also encompassed by the invention.

The tissue distribution in endometrial tumors combined with the homology to procollagen-proline dioxygenase indicates that polynucleotides and polypeptides corresponding to this gene are useful for diagnosis, treatment and prevention of these tumors, in addition to other tumors where expression has been indicated. The polypeptides of the invention is a good target for antagonists, particularly small molecules or antibodies, which block binding of the receptor by its cognate ligand(s). Accordingly, preferred are antibodies and or small molecules which specifically bind an extracellular portion of the translation product of this gene.

Also provided is a kit for detecting endometrial cancer. Such a kit comprises in one embodiment an antibody specific for the translation product of this gene bound to a solid support. Also provided is a method of detecting endometrial cancer in an individual which comprises a step of contacting an antibody specific for the translation product of this gene to a bodily fluid from the individual, preferably serum, and ascertaining whether antibody binds to an antigen found in the bodily fluid. Preferably the antibody is bound to a solid support and the bodily fluid is serum. Additionally, the homology to a conserved collagen metabolizing protein would suggest that this protein may also be important in the diagnosis or treatment of various autoimmune disorders such as rheumatoid arthritis, lupus, scleroderma, and dermatomyositis as well as dwarfism, spinal deformation, and specific joint abnormalities as well as chondrodysplasias ie. spondyloepiphyseal dysplasia congenita, familial osteoarthritis, Atelosteogenesis type II, metaphyseal chondrodysplasia type Schmid.

Furthermore, the protein may also be used to determine biological activity, raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 12

This gene is expressed in human osteoblastoma cell lines (5/23 unique sequences) and to a lesser extent in T cells (4/23).

Polynucleotides and polypeptides of the invention are useful as reagents for differential identification of the tissue(s) or cell type(s) present in a biological sample and for diagnosis of diseases and conditions which include, but are not limited to, osteoblastoma, and other bone-related disorders. Similarly, polypeptides and antibodies directed to these polypeptides are useful in providing immunological probes for differential identification of the tissue(s) or cell type(s). For a number of disorders of the above tissues or cells, particularly of the skeletal system, expression of this gene at significantly higher or lower levels may be routinely detected in certain tissues or cell types (e.g., bone and/or other tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in tumors of bone origins indicates that polynucleotides and polypeptides corresponding to this gene are useful for diagnosis and intervention of these tumors, in addition to other tumors where expression has been indicated. Additionally, this gene is a good target for antagonists, particularly small molecules or antibodies, which block binding of the receptor by its cognate ligand(s). Accordingly, preferred are antibodies and or small molecules which specifically bind an extracellular portion of the translation product of this gene. The extracellular regions can be ascertained from the information regarding the transmembrane domains as set out above.

Also provided is a kit for detecting osteoblastoma and other bone related cancers. Such a kit comprises in one embodiment an antibody specific for the translation product of this gene bound to a solid support. Also provided is a method of detecting bone related cancers in an individual which comprises a step of contacting an antibody specific for the translation product of this gene to a bodily fluid from the individual, preferably serum, and ascertaining whether antibody binds to an antigen found in the bodily fluid. Preferably the antibody is bound to a solid support and the bodily fluid is serum.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 13

The translation product of this gene is a human homolog of the mouse acetylcholine receptor gamma chain, and is almost identical to a human acetylcholine receptor gamma chain (See, e.g., Genbank Accession Nos.: emb|CAA27442.1| and gb|AAA51568.1|; all references available through these accessions are hereby incorporated by reference herein) which is thought to be important in transmission of nerve impulses to muscles.

Preferred polypeptides of the invention comprise, or alternatively consist of, an amino acid sequence selected from the group: LLADLMRNYDPHLRP (SEQ ID NO: 294), ISVTYFPFDWQNCSLIFQS (SEQ ID NO: 295), SMARGVRKVFLRLLPQ (SEQ ID NO: 296), QASPAIQACVDACNLMAR (SEQ ID NO: 297), and/or YNQVPDLPFPGDPRPYL (SEQ ID NO: 298). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridize, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention. This gene maps to chromosome 2, and therefore, may be used as a marker in linkage analysis for chromosome 2.

Included in this invention as preferred domains are Neurotransmitter-gated ion-channels domains, which were identified using the ProSite analysis tool. Structurally, members of the family of Neurotransmitter-gated ion-channels are composed of a large extracellular glycosylated N-terminal ligand-binding domain, followed by three hydrophobic transmembrane regions which form the ionic channel, followed by an intracellular region of variable length. A fourth hydrophobic region is found at the C-terminal of the sequence. In the N-terminal extracellular domain of AchR/GABA/5HT3/Gly receptors, there are two conserved cysteine residues, which, in AchR, have been shown to form a disulfide bond essential to the tertiary structure of the receptor. A number of amino acids between the two disulfide-bonded cysteines are also conserved. We have therefore used this region as a signature pattern for this subclass of proteins. The consensus pattern is as follows: C-x-[LIVMFQ]-x-[LIVMF]-x(2)-[FY]-P-x-D-x(3)-C.

In specific embodiments, polypeptides of the invention comprise, or alternatively consist of, the following amino acid sequence: CSISVTYFPFDWQNC (SEQ ID NO: 299).

Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridize, under stringent conditions, to the polynucleotide encoding this polypeptide are encompassed by the invention. Antibodies that bind polypeptides of the invention are also encompassed by the invention. Polynucleotides encoding said polypeptides are also encompassed by the invention.

Further preferred are polypeptides comprising the Neurotransmitter-gated ion-channel domain of the amino acid sequence referenced in Table 1A for this gene, and at least 5, 10, 15, 20, 25, 30, 50, or 75 additional contiguous amino acid residues of the amino acid sequence referenced in Table 1A for this gene. The additional contiguous amino acid residues may be N-terminal or C-terminal to the Neurotransmitter-gated ion-channel domain. Alternatively, the additional contiguous amino acid residues may be both N-terminal and C-terminal to the Neurotransmitter-gated ion-channel domain, wherein the total N- and C-terminal contiguous amino acid residues equal the specified number. The above preferred polypeptide domain is characteristic of a signature specific to Neurotransmitter-gated ion-channels. Additionally, the polypeptide of this gene has been determined to have transmembrane domains at about amino acid positions 311-327, 248-264, 477-493, and 276-292. of the amino acid sequence referenced in Table 1A for this gene. Based upon these characteristics, it is believed that the protein product of this gene shares structural features to type IIIa membrane proteins.

This gene is expressed in fetal tissues, specifically lung and Dura Mater. In addition, this gene was also detected in a differentially expressed human cerebellum and tonsil tissues.

Polynucleotides and polypeptides of the invention are useful as reagents for differential identification of the tissue(s) or cell type(s) present in a biological sample Similarly, polypeptides and antibodies directed to these polypeptides are useful in providing immunological probes for differential identification of the tissue(s) or cell type(s). For a number of disorders of the above tissues or cells, particularly fetal lung and brain, expression of this gene at significantly higher or lower levels may be routinely detected in certain tissues and cell types (e.g., developmental, neural, differentiating, and/or other tissues) or bodily fluids (e.g., lymph, serum, plasma, urine, synovial fluid and spinal fluid, pulmonary surfactant) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 146 as residues: Met-1 to Pro-7, Gln-21 to Glu-27, Arg-35 to Asp-49, Asn-66 to Leu-72, Trp-82 to Glu-95, Pro-158 to Asn-163. Polynucleotides encoding said polypeptides are also encompassed by the invention.

The tissue distribution in dura mater combined with the homology to a conserved acetylcholine receptor indicates that polynucleotides and polypeptides corresponding to this gene are useful for the detection, treatment, and/or prevention of neurodegenerative disease states, behavioral disorders, or inflammatory conditions. Representative uses are described in the "Regeneration" and "Hyperproliferative Disorders" sections below, in Example 11, 15, 39, 41, 42, 43, and 51, and elsewhere herein. Briefly, the uses include, but are not limited to the detection, treatment, and/or prevention of Alzheimer's Disease, Parkinson's Disease, Huntington's Disease, schizophrenia, mania, dementia, paranoia, obsessive compulsive disorder, panic disorder, learning disabilities, ALS, psychoses, autism, and altered behaviors, including disorders in feeding, sleep patterns, balance, and perception. Potentially, this gene product is involved in synapse formation, neurotransmission, learning, cognition, homeostasis, or neuronal differentiation or survival. In addition, the gene or gene product may also play a role in the treatment and/or detection of developmental disorders associated with the developing embryo, and/or disorders of the cardiovascular and pulmonary systems.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 14

In specific embodiments, polypeptides of the invention comprise, or alternatively consist of, the following amino acid sequence: VLKYALFLVLK NYYYCPY (SEQ ID NO: 300). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridize, under stringent conditions, to the polynucleotide encoding this polypeptide are encompassed by the invention. Antibodies that bind polypeptides of the invention are also encompassed by the invention. Polynucleotides encoding said polypeptides are also encompassed by the invention. The polypeptide of this gene has been determined to have transmembrane domains at about amino acid positions 29-45 and 8-24 of the amino acid sequence referenced in Table 1A for this gene. Based upon these characteristics, it is believed that the protein product of this gene shares structural features to type IIIa membrane proteins.

This gene is expressed in small intestine and to a lesser extent in lung cancer.

Polynucleotides and polypeptides of the invention are useful as reagents for differential identification of the tissue(s) or cell type(s) present in a biological sample and for diagnosis of diseases and conditions which include, but are not limited to, gastrointestinal and pulmonary disorders. Similarly, polypeptides and antibodies directed to these polypeptides are useful in providing immunological probes for differential identification of the tissue(s) or cell type(s). For a number of disorders of the above tissues or cells, particularly of the intestinal and pulmonary systems, expression of this gene at significantly higher or lower levels may be routinely detected in certain tissues or cell types (e.g., gastrointestinal, pulmonary, and/or other tissues) or bodily fluids (e.g., serum, plasma, urine, synovial fluid and spinal fluid, lymph, and/or pulmonary surfactant) or another tissue or cell sample taken from an individual having such a disorder, relative to the standard gene expression level, i.e., the expression level in healthy tissue or bodily fluid from an individual not having the disorder.

The tissue distribution in small intestine indicates a role in the detection and/or treatment of gastro-intestinal disorders including Whipple's disease, Ulcers, and indigestion. Expression in the lung indicates a potential role in the treatment and/or detection of certain pulmonary defects such as pulmonary edema and embolism, bronchitis, cystic fibrosis and lung cancer.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 15

The translation product of this gene shares sequence homology with mouse ECSIT (evolutionarily conserved signaling intermediate in Toll pathways: see, e.g., Genbank accession number AF18210.1; all references available through this accession are hereby incorporated by reference herein.) which is thought to be important in innate immune responses. More specifically, ECSIT is believed to be novel intermediate in these signaling pathways that bridges TRAF6 to MEKK-1. This adapter protein is specific for the Toll/IL-1 pathways and is a regulator of MEKK-1 processing. Expression of wild-type ECSIT accelerates processing of MEKK-1, whereas a dominant-negative fragment of ECSIT blocks MEKK-1 processing and activation of NF-kappaB. These results indicate an important role for ECSIT in signaling to NF-kappaB and suggest that processing of MEKK-1 is required for its function in the Toll/IL-1 pathway (e.g., Kopp et al., Genes Dev 1999 Aug. 15; 13(16):2059-71; this reference is hereby incorporated by reference in its entirety herein.). Based on the sequence similarity, the translation product of this gene is expected to share at least some biological activities with ECSIT proteins. Such activities are known in the art, some of which are described elsewhere herein.

In specific embodiments, polypeptides of the invention comprise, or alternatively consist of, the following amino acid sequence:

MREYGVERDLAVYNQLLNIFPKEVFRPR-NIIQRIFVHYPRQQECGIAVLEQMENH-GVMPNKETEFLLIQIFGR KSYPMLKLVRLKLWF-PRFMNVNPFPVPRDLPQDPVELAMFGLRHMEPDLS-ARVTIYQVPLPKDSTGAADPP QPHIVGIQSP-DQQAALARHNPARPVFVEGPFSLWL-RNKCVYYHILRADLLPPEEREVEETPEEWNLYYPMQ LDLEYVRSGWDNYEFDINEVEEGPVFAM-CMAGAHDQATMAKWIQGLQETNPTLA-QIPVVFRLAGSTRELQ TSSAGLEEPPLPEDHQEEDDN-LQRQQQGQS (SEQ ID NO: 301). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridize, under stringent conditions, to the polynucleotide encoding this polypeptide are encompassed by the invention. Antibodies that bind polypeptides of the invention are also encompassed by the invention. Polynucleotides encoding said polypeptides are also encompassed by the invention.

This gene is expressed in brain and to a lesser extent in pancreas, testes, and other tissue types.

Polynucleotides and polypeptides of the invention are useful as reagents for differential identification of the tissue(s) or cell type(s) present in a biological sample and for diagnosis of diseases and conditions which include, but are not limited to, neurological, behavioral, gastrointestinal, and endocrine disorders. Similarly, polypeptides and antibodies directed to these polypeptides are useful in providing immunological probes for differential identification of the tissue(s) or cell type(s). For a number of disorders of the above tissues or cells, particularly of the nervous system, expression of this gene at significantly higher or lower levels may be routinely detected in certain tissues or cell types (e.g., brain, endocrine, and/or other tissues) or bodily fluids (e.g., serum, plasma, urine, synovial fluid and spinal fluid, and lymph) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 148 as residues: Val-33 to Arg-39, Ser-57 to Thr-66, Pro-80 to Lys-86, Pro-155 to Cys-160, Val-215 to Pro-223, Pro-250 to Gly-255, Pro-311 to Glu-323, Arg-338 to Tyr-344, Ser-396 to Gln-401, Pro-410 to Ser-431. Polynucleotides encoding said polypeptides are also encompassed by the invention.

The tissue distribution (e.g., fetal tissue) and homology to ECSIT indicates that polynucleotides and polypeptides corresponding to this gene are useful for innate immune responses and/or Toll/IL-1 pathways and/or regulation of MEKK-1 processing.

The tissue distribution in brain indicates that polynucleotides and polypeptides corresponding to this gene are useful for the detection/treatment of neurodegenerative disease states and behavioral disorders such as Alzheimer's Disease, Parkinson's Disease, Huntington's Disease, schizophrenia, mania, dementia, paranoia, obsessive compulsive disorder, panic disorder, learning disabilities, ALS, psychoses, autism, and altered behaviors, including disorders in feeding, sleep patterns, balance, and perception. In addition, the gene or gene product may also play a role in the treatment and/or detection of developmental disorders associated with the developing embryo, sexually-linked disorders, or disorders of the cardiovascular system.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 16

The translation product of this gene shares sequence homology with the acid labile subunit of the insulin like growth factor binding subunit which is thought to be important in modulating the activity of Insulin like growth factor. In addition, this gene also shares homology with the melibiose carrier protein (thiomethylgalactoside permease II) of *Caenorhabditis elegans* (See Genebank Accession No. gi|1280135; all references available through this accession are hereby incorporated by reference herein).

Preferred polypeptides of the invention comprise, or alternatively consist of, an amino acid sequence selected from the group: FQFGWASTQISHLSLIPEL (SEQ ID NO: 302), LRYAFTVVANITVY (SEQ ID NO: 303), FVYGSMSFLD KVANGLA (SEQ ID NO: 304), WHLVGTVCVLLSFPFIF (SEQ ID NO: 305), and/or GHFLNDLCASMWFTY (SEQ ID NO: 306). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridize, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

This gene is expressed in macrophages and to a lesser extent in dendritic cells.

Polynucleotides and polypeptides of the invention are useful as reagents for differential identification of the tissue(s) or cell type(s) present in a biological sample and for diagnosis of diseases and conditions which include, but are not limited to, immune and hematopoeitic disorders. Similarly, polypeptides and antibodies directed to these polypeptides are useful in providing immunological probes for differential identification of the tissue(s) or cell type(s). For a number of disorders of the above tissues or cells, particularly of the hematopoetic and/or immune systems, expression of this gene at significantly higher or lower levels may be routinely detected in certain tissues or cell types (e.g. hematopoeitic, immune, and/or other tissues) or bodily fluids (e.g., serum, plasma, urine, synovial fluid and spinal fluid, and lymph) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 149 as residues: Ala-28 to Ala-33, Arg-38 to Leu-48, Thr-120 to Lys-125, Gly-155 to Gln-163, Gly-200 to Glu-214. Polynucleotides encoding said polypeptides are also encompassed by the invention.

The tissue distribution predominantly in dendritic cells and macrophages combined with homology to a growth factor binding subunit indicates that polynucleotides and polypeptides corresponding to this gene are useful for the treatment and diagnosis of hematopoietic related disorders such as anemia, pancytopenia, leukopenia, thrombocytopenia or leukemia since stromal cells are important in the production of cells of hematopoietic lineages. Representative uses are described in the "Immune Activity" and "Infectious Disease" sections below, in Example 11, 13, 14, 16, 18, 19, 20, 32, 33, 34, 53, and 58, and elsewhere herein. Briefly, the uses include bone marrow cell ex vivo culture, bone marrow transplantation, bone marrow reconstitution, radiotherapy or chemotherapy of neoplasia.

The gene product may also be involved in lymphopoiesis, therefore, it can be used in immune disorders such as infection, inflammation, allergy, immunodeficiency etc. In addition, this gene product may have commercial utility in the expansion of stem cells and committed progenitors of various blood lineages, and in the differentiation and/or proliferation of various cell types.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 17

Preferred polypeptides of the invention comprise, or alternatively consist of, an amino acid sequence selected from the group: AIPLRVLVVLWAF VLGLSRVMLGRHNVTD-VAFGFFLGYMQ (SEQ ID NO: 307), and/or VGLSRV-LGRHTDV (SEQ ID NO: 308). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridize, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

The gene encoding the disclosed cDNA is believed to reside on chromosome 9. Accordingly, polynucleotides related to this invention are useful as a marker in linkage analysis for chromosome 9.

This gene is expressed in placenta and small intestine.

Polynucleotides and polypeptides of the invention are useful as reagents for differential identification of the tissue(s) or cell type(s) present in a biological sample and for diagnosis of diseases and conditions which include, but are not limited to, pregnancy, reproductive, and/or gastrointestinal disorders. Similarly, polypeptides and antibodies directed to these polypeptides are useful in providing immunological probes for differential identification of the tissue(s) or cell type(s). For a number of disorders of the above tissues or cells, particularly of the intestinal and endocrine systems, expression of this gene at significantly higher or lower levels may be routinely detected in certain tissues or cell types (e.g., reproductive, gastrointestinal, and/or other tissues) or bodily fluids (e.g., lymph, serum, plasma, urine, synovial fluid and spinal fluid, amniotic fluid,) or another tissue or cell sample taken from an individual having such a disorder, relative to the standard gene expression level, i.e., the expression level in healthy tissue or bodily fluid from an individual not having the disorder.

The tissue distribution in placenta indicates a potential role for this protein in the detection and/or treatment of pregnancy disorders such as miscarriage and/or gastro-intestinal disorders such as indigestion, ulcers and Whipple's disease. Alternatively, polynucleotides and polypeptides corresponding to this gene are useful for the diagnosis, prevention, and/or treatment of various metabolic disorders such as Tay-Sachs disease, phenylkenonuria, galactosemia, porphyrias, and Hurler's syndrome.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 18

In specific embodiments, polypeptides of the invention comprise, or alternatively consist of, the following amino acid sequence: SFYKMKRN SYDRLRKVV (SEQ ID NO: 309). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridize, under stringent conditions, to the polynucleotide encoding this polypeptide are encompassed by the invention. Antibodies that bind polypeptides of the invention are also encompassed by the invention. Polynucleotides encoding said polypeptides are also encompassed by the invention.

The gene encoding the disclosed cDNA is believed to reside on chromosome 1. Accordingly, polynucleotides related to this invention are useful as a marker in linkage analysis for chromosome 1. The polypeptide of this gene has been determined to have a transmembrane domain at about amino acid position 8-24 of the amino acid sequence referenced in Table 1A for this gene. Moreover, a cytoplasmic tail encompassing amino acids 25-51 of this protein has also been determined Based upon these characteristics, it is believed that the protein product of this gene shares structural features to type Ib membrane proteins.

This gene is expressed in prostate and spleen and to a lesser extent in most cell types.

Polynucleotides and polypeptides of the invention are useful as reagents for differential identification of the tissue(s) or cell type(s) present in a biological sample and for diagnosis of diseases and conditions which include, but are not limited to, prostate and immune disorders. Similarly, polypeptides and antibodies directed to these polypeptides are useful in providing immunological probes for differential identification of the tissue(s) or cell type(s). For a number of disorders of the above tissues or cells, particularly of the immune and endocrine systems, expression of this gene at significantly higher or lower levels may be routinely detected in certain tissues or cell types (e.g., reproductive, immune, and/or other tissues) or bodily fluids (e.g., serum, plasma, urine, synovial fluid and spinal fluid, seminal fluid, and lymph) or another tissue or cell sample taken from an individual having such a disorder, relative to the standard gene expression level, i.e., the expression level in healthy tissue or bodily fluid from an individual not having the disorder.

The tissue distribution in prostate indicates a potential role in the treatment and/or detection of prostate disorders including benign prostate hyperplasia and prostate cancer. Expression in spleen indicates a role in the treatment and/or detection of spleen disorders such as splenitis and spleen cancer.

Alternatively, the expression in the spleen may suggest that polynucleotides and polypeptides corresponding to this gene are useful for the diagnosis and treatment of a variety of immune system disorders. Representative uses are described in the "Immune Activity" and "Infectious Disease" sections below, in Example 11, 13, 14, 16, 18, 19, 20, 32, 33, 34, 53, and 58, and elsewhere herein. Expression of this gene product in tonsils indicates a role in the regulation of the proliferation; survival; differentiation; and/or activation of potentially all hematopoietic cell lineages, including blood stem cells. This gene product may be involved in the regulation of cytokine production, antigen presentation, or other processes that may also suggest a usefulness in the treatment of cancer e.g. by boosting immune responses. Expression in cells of lymphoid origin, the natural gene product may be involved in immune functions. Therefore it may be also used as an agent for immunological disorders including arthritis, asthma, immune deficiency diseases such as AIDS, and leukemia.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues. In addition, this gene product may have commercial utility in the expansion of stem cells and committed progenitors of various blood lineages, and in the differentiation and/or proliferation of various cell types.

Features of Protein Encoded by Gene No: 19

This gene was shown to have homology to both a human IgE-binding protein as well as to the human gene for Human Factor XIII (See Genebank Accession Nos. gb|S76337|S76337 and Q25893, respectively).

Preferred polypeptides of the invention comprise, or alternatively consist of, an amino acid sequence selected from the group: LHQLRPPHRF PLIPPAAAEGAGAPPGCGYCVF-WLLNPLP (SEQ ID NO: 310), and/or MPWKRAVVLLM-LWFIGQAMWLAPAYVLEFQGKNTFLFIW-LAGLFFLLINCSILIQIISHYKEEPLTERIKYD (SEQ ID NO: 311). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridize, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

This gene is expressed in infant brain and fetal cochlea.

Polynucleotides and polypeptides of the invention are useful as reagents for differential identification of the tissue(s) or cell type(s) present in a biological sample and for diagnosis of diseases and conditions which include, but are not limited to, neurological, behavioral, and hearing disorders as well as disorders of the somatosensory and auditory cortices. Similarly, polypeptides and antibodies directed to these polypeptides are useful in providing immunological probes for differential identification of the tissue(s) or cell type(s). For a number of disorders of the above tissues or cells, particularly of the nervous system, expression of this gene at significantly higher or lower levels may be routinely detected in certain tissues or cell types (e.g., neural, immune, auditory, and/or other tissues) or bodily fluids (e.g., serum, plasma, urine, synovial fluid and spinal fluid, and lymph) or another tissue or cell sample taken from an individual having such a disorder, relative to the standard gene expression level, i.e., the expression level in healthy tissue or bodily fluid from an individual not having the disorder.

The tissue distribution in infant brain indicates that polynucleotides and polypeptides corresponding to this gene are useful for detection, treatment, and/or prevention of neurodegenerative disease states, behavioral disorders, or inflammatory conditions. Representative uses are described in the "Regeneration" and "Hyperproliferative Disorders" sections below, in Example 11, 15, 39, 41, 42, 43, and 51, and elsewhere herein. Briefly, the uses include, but are not limited to the detection, treatment, and/or prevention of Alzheimer's Disease, Parkinson's Disease, Huntington's Disease, schizophrenia, mania, dementia, paranoia, obsessive compulsive disorder, panic disorder, learning disabilities, ALS, psychoses, autism, and altered behaviors, including disorders in feeding, sleep patterns, balance, and perception. In addition, the gene or gene product may also play a role in the treatment and/or detection of developmental disorders associated with the developing embryo, sexually-linked disorders, or disorders of the cardiovascular system. Protein, as well as, antibodies directed against the protein may show utility as a tumor marker and/or immunotherapy targets for the above listed tumors and tissues.

Alternatively, considering the homology to a conserved human gene for IgE as well as to a conserved blood clotting factor may suggest this gene is useful for the diagnosis and treatment of a variety of immune system disorders. Homology of this gene to a blood clotting factor, specifically, indicates a role in the regulation of the proliferation; survival; differentiation; and/or activation of potentially all hematopoietic cell lineages, including blood stem cells. This gene product may be involved in the regulation of cytokine production, antigen presentation, or other processes that may also suggest a usefulness in the treatment of cancer e.g., by boosting immune responses. Since the gene may be expressed in cells of lymphoid origin, the natural gene product may be involved in immune functions. Therefore it may be also used as an agent for immunological disorders including arthritis, asthma, immune deficiency diseases such as AIDS, and leukemia.

The tissue distribution in fetal cochlea indicates that polynucleotides and polypeptides corresponding to this gene are useful for detection, treatment, and/or prevention of hearing disorders, cochlea dysfunction and/or disorders of the somatosensory and auditory cortices.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues. In addition, this gene product may have commercial utility in the expansion of stem cells and committed progenitors of various blood lineages, and in the differentiation and/or proliferation of various cell types.

Features of Protein Encoded by Gene No: 20

Preferred polypeptides of the invention comprise, or alternatively consist of, an amino acid sequence selected from the group: ARAQPFAFQLRPAPGRPGSPVA (SEQ ID NO: 312), AGLPGALTAPAXHHHADSRPAELVVQPL-SPPRPLLSHAGLASAAG ASSLXRVPGEAESLCALSPG-SALRFPAASCSRPXREPSGDEGTA-GALPSPWLAALGPGGRPAVRRVLPRLGG RAGQLPRGLPVPRGLRHAGRYHLLRLL-RAPLLLRRGRRQAGAGRLHQRPPRT-GAPRHHCAACLRPLSHRR LHLHCVHHPGLCS-GYLLLHLFETQGALAAANPLLTPQLSDRDPAHDPDL-HQPQGTLPAVQHSHELQLHRRL HPQV-LLSHLVSWCHPSI SLTPFSRSPHWLGRAVQTFSSX (SEQ ID NO: 313), AGLPGALTAPAXHHHADSRPAELV-VQPLSPPRPLLSHA (SEQ ID NO: 314), GLASAAGAS-SLXRVPGEAESLCALSPGSALRFPAASCSRP (SEQ ID NO: 315), XREPSGDEGTAGALPSPWLAALGPGGR-PAVRRVLPRLGGR (SEQ ID NO: 316), AGQL-PRGLPVPRGLRHAGRYHLLRLLRAPLLLRRGRRQAG (SEQ ID NO: 317), AGRLHQRPPRTGAPRHHCAACLR-PLSHRRLHLHCVHHPGL (SEQ ID NO: 318), CSGYLLLHLFETQGALAAANPLLTPQLS-DRDPAHDPDLHQ (SEQ ID NO: 319), and/or PQGTL-PAVQHSHELQLHRRLHPQV-LLSHLVSWCHPSISLTPFSRSPHWLG RAVQTFSSX (SEQ ID NO: 320). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridize, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

The gene encoding the disclosed cDNA is believed to reside on chromosome 4. Accordingly, polynucleotides related to this invention are useful as a marker in linkage analysis for chromosome 4.

This gene is expressed in heart and to a lesser extent in the embryo.

Polynucleotides and polypeptides of the invention are useful as reagents for differential identification of the tissue(s) or cell type(s) present in a biological sample and for diagnosis of diseases and conditions which include, but are not limited to, cardiovascular and developmental disorders Similarly, polypeptides and antibodies directed to these polypeptides are useful in providing immunological probes for differential identification of the tissue(s) or cell type(s). For a number of disorders of the above tissues or cells, particularly of the cardiovascular and developmental systems, expression of this gene at significantly higher or lower levels may be routinely detected in certain tissues or cell types (e.g., cardiopulmonary, developmental, and/or other tissues) or bodily fluids (e.g., lymph, sputum, serum, plasma, urine, synovial fluid and spinal fluid, amniotic fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 153 as residues: Gln-23 to Gly-30, Gln-35 to Gln-43, Leu-73 to Glu-84, Arg-125 to Pro-133, Ser-140 to Thr-145, Thr-153 to Thr-164. Polynucleotides encoding said polypeptides are also encompassed by the invention.

The tissue distribution in heart indicates that polynucleotides and polypeptides corresponding to this gene are useful for the treatment and/or detection of a range of vascular conditions, which include, but are not limited to, microvascular disease, vascular leak syndrome, aneurysm, stroke, atherosclerosis, arteriosclerosis, embolism, vasculitis, myocardial infarction, myocarditis, ischemia, stroke, in addition to developmental and metabolic disorders. For example, this gene product may represent a soluble factor produced by smooth muscle that regulates the innervation of organs or regulates the survival of neighboring neurons. Likewise, it may be involved in controlling the digestive process, and such actions as peristalsis. Similarly, it may be involved in controlling the vasculature in areas where smooth muscle surrounds the endothelium of blood vessels.

Alternatively, the expression in embryonic tissue indicates that polynucleotides and polypeptides corresponding to this gene are useful for the diagnosis and treatment of cancer and other proliferative disorders. Furthermore, protein may play a role in the regulation of cellular division. In such an event, this gene may be useful in the treatment of lymphoproliferative disorders, and in the maintenance and differentiation of various hematopoietic lineages from early hematopoietic stem and committed progenitor cells. Similarly, embryonic development also involves decisions involving cell differentiation and/or apoptosis in pattern formation. Thus this protein may also be involved in apoptosis or tissue differentiation and could again be useful in cancer therapy.

Furthermore, the protein may also be used to determine biological activity, raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 21

The gene encoding the disclosed cDNA is believed to reside on chromosome 17. Accordingly, polynucleotides related to this invention are useful as a marker in linkage analysis for chromosome 17.

This gene is expressed in human teratocarcinoma cell line treated with retinoic acid, Hodgkin's Lymphoma human, and brain.

Polynucleotides and polypeptides of the invention are useful as reagents for differential identification of the tissue(s) or cell type(s) present in a biological sample and for diagnosis of diseases and conditions which include, but are not limited to, developmental abnormalities, neural disorders, or Hodgkin's disease. Similarly, polypeptides and antibodies directed to these polypeptides are useful in providing immunological probes for differential identification of the tissue(s) or cell type(s). For a number of disorders of the above tissues or cells, particularly of the nervous system, expression of this gene at significantly higher or lower levels may be routinely detected in certain tissues or cell types (e.g., developing, differentiating, neural, and/or other tissues) or bodily fluids (e.g., lymph, serum, plasma, urine, synovial fluid and spinal fluid, amniotic fluid) or another tissue or cell sample taken from an individual having such a disorder, relative to the standard gene expression level, i.e., the expression level in healthy tissue or bodily fluid from an individual not having the disorder.

The tissue distribution in teratocarcinoma cell line indicates that polynucleotides and polypeptides corresponding to this gene are useful for early diagnosis and treatment of developmental abnormalities, including agenesis, aplasia, hypoplasia, dysraphic anormalities, division failures, dysplasia, etc. Additionally, the gene and its expression can be used for teratogen detection or classification.

Alternatively, considering the expression within human brain tissue may suggest that polynucleotides and polypeptides corresponding to this gene are useful for the detection/treatment of neurodegenerative disease states and behavioral disorders such as Alzheimer's Disease, Parkinson's Disease, Huntington's Disease, schizophrenia, mania, dementia, paranoia, obsessive compulsive disorder, panic disorder, learning disabilities, ALS, psychoses, autism, and altered behaviors, including disorders in feeding, sleep patterns, balance, and perception. In addition, the gene or gene product may also play a role in the treatment and/or detection of developmental disorders associated with the developing embryo.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 22

The translation product of this gene was shown to have homology to the human B-cell growth factor which is known to be involved in the maturation of B-cells (See Genebank Accession No. gi|522145; all references available through this accession are hereby incorporated by reference herein).

Preferred polypeptides of the invention comprise, or alternatively consist of, an amino acid sequence selected from the group: VAHTCNLSTLGGQG GRIERTAGQEFKTS (SEQ ID NO: 321) and HYKSYACRYRSGIRGRVDEVLTNCH-WTYLKQNRKMAANSSGQALHSRDPL-LIRTSGITLSSSILQPNRRQLC SMLMHIHLDTSSLK-TLHLGTLFFLFYLALTQNEENICDGKVTL (SEQ ID NO: 322). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridize, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

The gene encoding the disclosed cDNA is believed to reside on chromosome 9. Accordingly, polynucleotides related to this invention are useful as a marker in linkage analysis for chromosome 9.

This gene is expressed in multiple sclerosis and prostate tissues and to a lesser extent in brain and osteoblasts.

Polynucleotides and polypeptides of the invention are useful as reagents for differential identification of the tissue(s) or cell type(s) present in a biological sample and for diagnosis of diseases and conditions which include, but are not limited to, muscle, reproductive, bone and neural disorders. Similarly, polypeptides and antibodies directed to these polypeptides are useful in providing immunological probes for differential identification of the tissue(s) or cell type(s). For a number of disorders of the above tissues or cells, particularly of the central nervous system and/or PNS, expression of this gene at significantly higher or lower levels may be routinely detected in certain tissues or cell types (e.g., muscle, reproductive, and/or other tissues) or bodily fluids (e.g., lymph, serum, plasma, urine, synovial fluid and spinal fluid, seminal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 155 as residues: Gln-28 to Asp-35. Polynucleotides encoding said polypeptides are also encompassed by the invention.

The tissue distribution in multiple sclerosis indicates that polynucleotides and polypeptides corresponding to this gene are useful for the detection, treatment, and/or prevention of neurodegenerative disease states, behavioral disorders, or inflammatory conditions. Representative uses are described in the "Regeneration" and "Hyperproliferative Disorders" sections below, in Example 11, 15, 39, 41, 42, 43, and 51, and elsewhere herein. Briefly, the uses include, but are not limited to the detection, treatment, and/or prevention Alzheimer's Disease, Parkinson's Disease, Huntington's Disease, schizophrenia, mania, dementia, paranoia, obsessive compulsive disorder, panic disorder, learning disabilities, ALS, psychoses, autism, and altered behaviors, including disorders in feeding, sleep patterns, balance, and perception. In addition, the gene or gene product may also play a role in the treatment and/or detection of developmental disorders associated with the developing embryo, sexually-linked disorders, or disorders of the cardiovascular system.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 23

The translation product of this gene was shown to have homology to the B0035.14 gene of *Caenorhabditis elegans* (See, e.g., Genbank Accession No. gn1|PID|e242592; all references available through this accession are hereby incorporated by reference herein).

Preferred polypeptides of the invention comprise, or alternatively consist of, an amino acid sequence selected from the group: TIKMQTENLGVVYYVNKDF (SEQ ID NO: 323), MVSNPPY (SEQ ID NO: 325), HASEL (SEQ ID NO: 326), RESWYACRYRSGIPGSTHASELMPIIVLILVSLLSQLM-VSNPPYSLYPRSGTGQTIKMQTENLGVVYYVNKD-FKNEYKGMLLQKVEKSVEEDYVTNIRNNCWKER-QQKTDMQYAAKVYRDDRLRRRQMP (SEQ ID NO: 327) and/or VEEDYVTNIRNNC (SEQ ID NO: 324). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridize, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

The gene encoding the disclosed cDNA is believed to reside on chromosome 4. Accordingly, polynucleotides related to this invention are useful as a marker in linkage analysis for chromosome 4.

This gene is expressed in bone marrow and to a lesser extent in lung and various tissues.

Polynucleotides and polypeptides of the invention are useful as reagents for differential identification of the tissue(s) or cell type(s) present in a biological sample and for diagnosis of diseases and conditions which include, but are not limited to, hematopoietic, and/or cardiopulmonary disorders. Similarly, polypeptides and antibodies directed to these polypeptides are useful in providing immunological probes for differential identification of the tissue(s) or cell type(s). For a number of disorders of the above tissues or cells, particularly of the hematopoietic system, expression of this gene at significantly higher or lower levels may be routinely detected in certain tissues or cell types (e.g., proliferating, haematopoeitic, and/or other tissues) or bodily fluids (e.g., lymph, serum, plasma, urine, synovial fluid and spinal fluid, pulmonary surfactant) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 156 as residues: Ile-34 to Glu-39, Lys-49 to Lys-56, Val-63 to Glu-68, Thr-73 to Asp-88, Arg-97 to Pro-107. Polynucleotides encoding said polypeptides are also encompassed by the invention.

The tissue distribution in bone marrow indicates that polynucleotides and polypeptides corresponding to this gene are useful for the treatment and diagnosis of hematopoietic related disorders such as anemia, pancytopenia, leukopenia, thrombocytopenia or leukemia since stromal cells are important in the production of cells of hematopoietic lineages. Representative uses are described in the "Immune Activity" and "Infectious Disease" sections below, in Example 11, 13, 14, 16, 18, 19, 20, 32, 33, 34, 53, and 58, and elsewhere herein. Briefly, the uses include bone marrow cell ex vivo culture, bone marrow transplantation, bone marrow reconstitution, radiotherapy or chemotherapy of neoplasia.

The gene product may also be involved in lymphopoiesis, therefore, it can be used in immune disorders such as infection, inflammation, allergy, immunodeficiency, etc. In addition, this gene product may have commercial utility in the expansion of stem cells and committed progenitors of various blood lineages, and in the differentiation and/or proliferation of various cell types.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 24

In specific embodiments, polypeptides of the invention comprise, or alternatively consist of, the following amino acid sequence: LVALDRMEYVR TFRKREDLRGRLF-WVALDLLDLLD (SEQ ID NO: 328). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridize, under stringent conditions, to the polynucleotide encoding this polypeptide are encompassed by the invention. Antibodies that bind polypeptides of the invention are also encompassed by the invention. Polynucleotides encoding said polypeptides are also encompassed by the invention.

The polypeptide of this gene has been determined to have transmembrane domains at about amino acid positions 20-36 and 53-69 of the amino acid sequence referenced in Table 1A for this gene. Based upon these characteristics, it is believed that the protein product of this gene shares structural features to type IIIa membrane proteins.

This gene is expressed in T-cells and breast cancer tissue.

Polynucleotides and polypeptides of the invention are useful as reagents for differential identification of the tissue(s) or cell type(s) present in a biological sample and for diagnosis of diseases and conditions which include, but are not limited to, immune disorders and breast cancer. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., immune, breast, proliferating, and/or other tissues) or bodily fluids (e.g., serum, plasma, urine, synovial fluid and spinal fluid, breast milk, and lymph) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 157 as residues: Tyr-105 to Pro-113, Gln-122 to Pro-133, Pro-140 to Asp-155. Polynucleotides encoding said polypeptides are also encompassed by the invention.

The tissue distribution in T cells and breast cancer indicates that polynucleotides and polypeptides corresponding to this gene are useful for the diagnosis and treatment of a variety of immune system disorders and breast cancer. Representative uses are described in the "Immune Activity" and "Infectious Disease" sections below, in Example 11, 13, 14, 16, 18, 19, 20, 32, 33, 34, 53, and 58, and elsewhere herein. Briefly, the expression of this gene product in T-cells indicates a role in the regulation of the proliferation; survival; differentiation; and/or activation of potentially all hematopoietic cell lineages, including blood stem cells. This gene product may be involved in the regulation of cytokine production, antigen presentation, or other processes that may also suggest a usefulness in the treatment of cancer e.g., by boosting immune responses. Expression in cells of lymphoid origin, the natural gene product may be involved in immune functions. Therefore it may be also used as an agent for immunological disorders including arthritis, asthma, immune deficiency diseases such as AIDS, and leukemia.

Furthermore, the protein may also be used to determine biological activity, raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues. In addition, this gene product may have commercial utility in the expansion of stem cells and committed progenitors of various blood lineages, and in the differentiation and/or proliferation of various cell types. The expression of the gene in the breast cancer tissue may indicate T-cell mediated immune reaction to the cancer tissue.

Features of Protein Encoded by Gene No: 25

The translation product of this gene shares sequence homology with an yeast ankyrin repeat-containing protein Akr1p which is thought to be important in pheromone response pathway (See Genebank Accession No. gi|466522; all references available through this accession are hereby incorporated by reference herein).

Preferred polypeptides of the invention comprise, or alternatively consist of, an amino acid sequence selected from the group: SVALFYNFGKSWKSDPGI IKXTEEQKKKTIVE-LAETGSLDLSIFCSTCLIRK PVR SK H CGVCNRCIAK-FDHHCPWVGNCVGAGNHRYF (SEQ ID NO: 329), FDHHCPWVGNCV (SEQ ID NO: 330), and/or QMYQIS-CLGITTNERMNARR (SEQ ID NO: 331). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridize, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

The gene encoding the disclosed cDNA is believed to reside on chromosome 12. Accordingly, polynucleotides related to this invention are useful as a marker in linkage analysis for chromosome 12. The polypeptide of this gene has been determined to have a transmembrane domain at about amino acid position 53-69 of the amino acid sequence referenced in Table 1A for this gene. Moreover, a cytoplasmic tail encompassing amino acids 70-150 of this protein has also been determined. Based upon these characteristics, it is believed that the protein product of this gene shares structural features to type Ia membrane proteins.

This gene is expressed in human lung cancer cells, B-cell lymphoma and to a lesser extent in fetal tissues and tumor cells of various origins.

Polynucleotides and polypeptides of the invention are useful as reagents for differential identification of the tissue(s) or cell type(s) present in a biological sample and for diagnosis of diseases and conditions which include, but are not limited to, cancer of various origins, particularly of the lungs and hematopoietic systems. Similarly, polypeptides and antibodies directed to these polypeptides are useful in providing immunological probes for differential identification of the tissue(s) or cell type(s). For a number of disorders of the above tissues or cells, particularly of the lung, expression of this gene at significantly higher or lower levels may be routinely detected in certain tissues or cell types (e.g., lung, cancerous and wounded tissues) or bodily fluids (e.g., serum, plasma, urine, synovial fluid and spinal fluid, pulmonary surfactant, and lymph) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 158 as residues: Thr-28 to Phe-35, Asp-140 to Ser-145. Polynucleotides encoding said polypeptides are also encompassed by the invention.

The tissue distribution in lung cancer indicates that polynucleotides and polypeptides corresponding to this gene are useful for the diagnosis and treatment of a variety of immune system disorders. Representative uses are described in the "Immune Activity" and "Infectious Disease" sections below, in Example 11, 13, 14, 16, 18, 19, 20, 32, 33, 34, 53, and 58, and elsewhere herein.

Briefly, the expression of this gene product in lymphomas indicates a role in the regulation of the proliferation; survival; differentiation; and/or activation of potentially all hematopoietic cell lineages, including blood stem cells. This gene product may be involved in the regulation of cytokine production, antigen presentation, or other processes that may also suggest a usefulness in the treatment of cancer e.g., by boosting immune responses. Expression in cells of lymphoid origin, the natural gene product may be involved in immune functions. Therefore it may be also used as an agent for immunological disorders including arthritis, asthma, immune deficiency diseases such as AIDS, and leukemia. Protein, as well as, antibodies directed against the protein may show utility as a tumor marker and/or immunotherapy targets for the above listed tumors and tissues.

In addition, this gene product may have commercial utility in the expansion of stem cells and committed progenitors of various blood lineages, and in the differentiation and/or proliferation of various cell types. Alternatively, distribution in tumor tissues indicates that polynucleotides and polypeptides corresponding to this gene are useful for diagnosis and treatment of cancers of various origins, especially lung B-cell lymphoa, stomach cancer, osteoclastoma.

Additionally, this gene is a good target for antagonists, particularly small molecules or antibodies, which block binding of the receptor by its cognate ligand(s). Accordingly, preferred are antibodies and or small molecules which specifically bind an extracellular portion of the translation product of this gene. Also provided is a kit for detecting lung cancer. Such a kit comprises in one embodiment an antibody specific for the translation product of this gene bound to a solid support. Also provided is a method of detecting lung cancer in an individual which comprises a step of contacting an antibody specific for the translation product of this gene to a bodily fluid from the individual, preferably serum, and ascertaining whether antibody binds to an antigen found in the bodily fluid. Preferably the antibody is bound to a solid support and the bodily fluid is serum.

Furthermore, the protein may also be used to determine biological activity, raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 26

The gene encoding the disclosed cDNA is believed to reside on chromosome 15. Accordingly, polynucleotides related to this invention are useful as a marker in linkage analysis for chromosome 15.

This gene is expressed in infant brain, fetal tissue (e.g., heart), tumors and to a lesser extent in a variety of other tissues and cell types.

Polynucleotides and polypeptides of the invention are useful as reagents for differential identification of the tissue(s) or cell type(s) present in a biological sample and for diagnosis of diseases and conditions which include, but are not limited to, developmental and neurodegenerative diseases of the brain and nervous system, as well as, cancer, in general. Similarly, polypeptides and antibodies directed to these polypeptides are useful in providing immunological probes for differential identification of the tissue(s) or cell type(s). For a number of disorders of the above tissues or cells, particularly of the brain, CNS, and/or PNS, expression of this gene at significantly higher or lower levels may be routinely detected in certain tissues or cell types (e.g., developmental, differentiating, neural, and/or other tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 159 as residues: Ser-33 to Ile-41. Polynucleotides encoding said polypeptides are also encompassed by the invention.

The tissue distribution in infant brain indicates polynucleotides and polypeptides corresponding to this gene are useful for the detection, treatment, and/or prevention of neurodegenerative disease states, behavioral disorders, or inflammatory conditions. Representative uses are described in the "Regeneration" and "Hyperproliferative Disorders" sections below, in Example 11, 15, 39, 41, 42, 43, and 51, and elsewhere herein.

Briefly, the uses include, but are not limited to the detection, treatment, and/or prevention of Alzheimer's Disease, Parkinson's Disease, Huntington's Disease, Tourette's Syndrome, meningitis, encephalitis, demyelinating diseases, peripheral neuropathies, neoplasia, trauma, congenital malformations, spinal cord injuries, ischemia and infarction, aneurysms, hemorrhages, schizophrenia, mania, dementia, paranoia, obsessive compulsive disorder, depression, panic disorder, learning disabilities, ALS, psychoses, autism, and altered behaviors, including disorders in feeding, sleep patterns, balance, and perception. In addition, elevated expression of this gene product in regions of the brain indicates it plays a role in normal neural function. Potentially, this gene product is involved in synapse formation, neurotransmission, learning, cognition, homeostasis, or neuronal differentiation or survival.

Moreover, the expression within fetal, embryonic tissue and other cellular sources marked by proliferating cells indicates this protein may play a role in the regulation of cellular division, and may show utility in the diagnosis, treatment, and/or prevention of developmental diseases and disorders, including cancer, and other proliferative conditions. Representative uses are described in the "Hyperproliferative Disorders" and "Regeneration" sections below and elsewhere herein. Briefly, developmental tissues rely on decisions involving cell differentiation and/or apoptosis in pattern formation. Dysregulation of apoptosis can result in inappropriate suppression of cell death, as occurs in the development of some cancers, or in failure to control the extent of cell death, as is believed to occur in acquired immunodeficiency and certain degenerative disorders, such as spinal muscular atrophy (SMA). Alternatively, this gene product may be involved in the pattern of cellular proliferation that accompanies early embryogenesis. Thus, aberrant expression of this gene product in tissues—particularly adult tissues—may correlate with patterns of abnormal cellular proliferation, such as found in various cancers.

Because of potential roles in proliferation and differentiation, this gene product may have applications in the adult for tissue regeneration and the treatment of cancers. It may also act as a morphogen to control cell and tissue type specification. Therefore, the polynucleotides and polypeptides of the present invention are useful in treating, detecting, and/or preventing said disorders and conditions, in addition to other types of degenerative conditions. Thus this protein may modulate apoptosis or tissue differentiation and is useful in the detection, treatment, and/or prevention of degenerative or proliferative conditions and diseases. The protein is useful in modulating the immune response to aberrant polypeptides, as may exist in proliferating and cancerous cells and tissues. The protein can also be used to gain new insight into the regulation of cellular growth and proliferation.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 27

The translation product of this gene shares sequence homology with a zinc transporter, ZnT-1, which is thought to regulate zinc excretion from cells and maintain homeostasis (See Genebank Accession No. gb|AAA79234.1|, all references available through this accession are hereby incorporated by reference herein; as well as Palmiter and Findley, EMBO J. 14:639-649 (1995), which is hereby incorporated by reference herein). Transformation of normal cells with a mutant rat ZnT-1 lacking the first membrane-spanning domain conferred zinc sensitivity on wild-type cells, suggests that ZnT-1 functions as a multimer. Deletion of the first two membrane-spanning domains resulted in a non-functional molecule, whereas deletion of the C-terminal tail produced a toxic phenotype.

Transmembrane domains of the protein of the current invention are predicted using PSORT to comprise the following amino acid residues as shown in SEQ ID NO: 160: Ser-42 to Ala-58, Ala-83 to Leu-99, Leu-115 to Gly-131, Val-249 to Val-265, and/or Val-314 to Leu-330.

Therefore, preferred polypeptides of the present invention are the predicted extracellular domains, comprising, or alternatively consisting of, an amino acid sequence selected from the group: RVTSSLAMLSDS (SEQ ID NO: 332), AIERFIEPHEMQQPL (SEQ ID NO: 333), AGIRHERNRGRLLCMLALTFMFMVLEVVVSRVTSSLAMLSD SFHMLSDVLALVVALVAERFARRTHATQKNTFGWIRAEVMGALVNAIFLTGLCFAILLEAIERFIEPHEMQQ PLVVLGVGVAGLLVNVLGLCLFHHHSGFSQDSGHXHSHGGHGHGHGLPKGPRVKSTRPGSSDINVAPGEQ GPDQEETNTLVANTSNSNGLKLDPAD-
PENPRSGDTVEV QVNGNLVREPDHMELEEDRAGQL-
NMRGVFLH VLGDALGSVIVVVNALVFYFSWKGC-
SEGDFCVNPCFPDPCKPFVEIINSTHASVYEAGPCWV-
LYLDPTLCV VMVCILLYTTYPLLKESALILLQTVPK-
QIDIRNLIKELRNVEGVEEVHELHVWQLAGSRII-
ATAHIKCEDPTSY MEVAKXIKDVFHNHGIHATTIQPE-
FASVGSKSSVVPCELACRTQCALKQC-
CGTLPQAPSGKDAEKTPAVSIS CLELSNNLEKKPRRT-
KAENIPAVVIEIKNMPKQTT (SEQ ID NO: 336) and/or
NALVFYFSWKGCSEGDFCVNPCFPDPCK PFVEIINST-
HASVYEAGPCWV (SEQ ID NO: 334). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridize, under stringent conditions, to the polynucleotide encoding this polypeptide are encompassed by the invention. Antibodies that bind polypeptides of the invention are also encompassed by the invention. Polynucleotides encoding this sequence are also provided.

In addition, in specific embodiments, polypeptides of the invention comprise, or alternatively consist of, the following amino acid sequence: AGIRHERNRGRLLCMLALTFM-
FMVLEVVVSRVTSSLAMLSDSFH MLSDVLALVVAL-
VAERFARRTHATQKNTFGWIRAEVM-
GALVNAIFLTGLCFAILLEAIERFIEPHEMQQPLV
VLGVGVAGLLVNVLGLCLFHHHSGF-
SQDSGHXHSHGGHGHGHGLPKGPRVKSTRPGSSDI
NVAPGEQGPD QEETNTLVANTSNSNGLKLDPADPEN-
PRSGDTVEVQVNGNLVREPDHMELEE-
DRAGQLNMRGVFLHVLG DALGSVIVVVNALVFYF-
SWKGCSEGDFCVNPCFPDPCKAFVEILIVLMHQFM
(SEQ ID NO: 335). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridize, under stringent conditions, to the polynucleotide encoding this polypeptide are encompassed by the invention. Antibodies that bind polypeptides of the invention are also encompassed by the invention. Polynucleotides encoding this sequence are also provided.

The polypeptide of this gene has been determined to have multiple transmembrane domains (e.g., about amino acid position 69-85, 101-117, 300-316, 235-251, and 28-44 of the amino acid sequence referenced in Table 1A for this gene). Based upon these characteristics, it is believed that the protein product of this gene shares structural features to type IIIa membrane proteins.

This gene is expressed in colon, lung, liver, lymphoma, osteosarcoma, adrenal gland and parathyroid tumor and fibroblasts.

Polynucleotides and polypeptides of the invention are useful as reagents for differential identification of the tissue(s) or cell type(s) present in a biological sample and for diagnosis of diseases and conditions which include, but are not limited to, Hodgkin's Lymphoma, osteosarcoma, neurodegenerative disorders, gastrointestinal disorders, and cancer of many tissues. Similarly, polypeptides and antibodies directed to these polypeptides are useful in providing immunological probes for differential identification of the tissue(s) or cell type(s). For a number of disorders of the above tissues or cells, particularly of the central nervous system, expression of this gene at significantly higher or lower levels may be routinely detected in certain tissues or cell types (e.g., neural, gastrointestinal, and/or other tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 160 as residues: Arg-50 to Thr-58, Ser-125 to Gly-132. Polynucleotides encoding said polypeptides are also encompassed by the invention.

The tissue distribution and homology to ZnT-1 indicates that polynucleotides and polypeptides corresponding to this gene are useful for treatment and diagnosis of disorders associated with the regulation of zinc homeostasis. Although zinc is an important trace element in many biological systems, several lines of evidence suggest that this transporter may serve as a point of intervention particularly in the treatment of neurological diseases. The metabolism of zinc in the brain has been shown to be regulated by a number of transport proteins, including ZnT-1. Pharmacological doses of zinc cause neuronal death, and some estimates indicate that extracellular concentrations of zinc could reach neurotoxic levels under pathological conditions. In Alzheimer's disease, zinc has been shown to aggregate beta-amyloid, a form which is potentially neurotoxic. The zinc-dependent transcription factors NF-kappa B and Sp1 bind to the promoter region of the amyloid precursor protein (APP) gene. Zinc also inhibits enzymes which degrade APP to nonamyloidogenic peptides and which degrade the soluble form of beta-amyloid. The changes in zinc metabolism which occur during oxidative stress may be important in neurological diseases where oxidative stress is implicated, such as Alzheimer's disease, Parkinson's disease, and amyotrophic lateral sclerosis (ALS). Zinc is a structural component of superoxide dismutase 1, mutations of which give rise to one form of familiar ALS. After HIV infection, zinc deficiency is found which may be secondary to immune-induced cytokine synthesis. Zinc is involved in the replication of the HIV virus at a number of sites. Collectively, this transporter may prove useful in the treatment and diagnosis of several disorders related to zinc regulation.

Alternatively, the tissue distribution within lymphomas indicates that polynucleotides and polypeptides corresponding to this gene are useful for the diagnosis and treatment of a variety of immune system disorders. Expression of this gene product in immune tissue indicates a role in the regulation of the proliferation; survival; differentiation; and/or activation of potentially all hematopoietic cell lineages, including blood stem cells.

This gene product may be involved in the regulation of cytokine production, antigen presentation, or other processes that may also suggest a usefulness in the treatment of cancer e.g. by boosting immune responses. Expression in cells of lymphoid origin, the natural gene product may be involved in immune functions. Therefore it may be also used as an agent for immunological disorders including arthritis, asthma, immune deficiency diseases such as AIDS, and leukemia.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues. In addition, this gene product may have commercial utility in the expansion of stem cells and committed progenitors of various blood lineages, and in the differentiation and/or proliferation of various cell types.

Features of Protein Encoded by Gene No: 28

The translation product of this gene was shown to have homology to the mouse interferon-stimulated gene 15 and human calnexin (See Genbank Accession Nos. gb|AAB02697.1| and gi|306481|gb|AAA21013.1|; all references available through these accessions are hereby incorporated by reference herein) which may implicate this gene as playing a role in regulation of proliferating and differentiating cells.

Preferred polypeptides comprise, or alternatively consist of, an amino acid sequence selected from the group: MFTFASMTKEDSKLIALIWPSEWQMIQKLFV-VDHVIKITRIEVGDVNPSETQYISEPKLCPECREGLLC QQQRDLREYTQATIYVHKVVDNKKVMKD-SAPELNVSSSETEEDKEEAKPDGEKDPDFNQSXGGT KRQKISHQNYIAYQKQVIRRSMRHRKVRGE KALLVSANQTLKELKIQIMHAFS-VAPFDQNLSIDGKILSDDCATLGTL GVIPES-VILLKADEPIADYAAMDDVMQVCMPEEG-FKGTGLLGH (SEQ ID NO: 337), SAPELNVSSSETEE DKEEAKP (SEQ ID NO: 338), FQDKNRPCLSNWPEDT-DVLYIVSQFFVEEWRKFVRKPTRCSPVSSVGNS ALLCPHGGLMFTFASMTKEDSKLIALI-WPSEWQMIQKLFVVDHVIKITRIEVGD-VNPSETQYISEPKLCPECR EGLLCQQQRDL-REYTQATIYVHKVVDNKKVMKDSAPELNVSSSETEE-DKEEAKPDGEKDPDFNQSXGGTK RQKISHQNY-IAYQKQVIRRSMRHRKVRGEKALLVSAN-QTLKELKIQIMHAFSVAPFDQNLSIDGKILSDDCA TLGTLGVIPESVILLKADEPIADYAAMD-DVMQVCMPEEGFKGTGLLGH (SEQ ID NO: 347), FQD-KNRPC LS NWPEDTDVLYIVSQFFVEEWRKFVRKP-TRCSPVSSVGNSALLCPHGGL (SEQ ID NO: 340), MFTFASMTKE DSKLIALIWPSEWQMIQKLFVVDHVI KITRIE (SEQ ID NO: 341), VGDVNPSETQYISEPKL-CPECREGLLCQ QQRDLR EYTQATIY (SEQ ID NO: 342), VHKVVDNKKVMKDSAPELNVSSSETEED-KEEAKP DGEKDPDF (SEQ ID NO: 343), NQSXGGT-KRQKISHQNYIAYQKQVIRRSMRHRK VRGEKALLV (SEQ ID NO: 344), SAN QTLKELKIQIMHAFS-VAPFDQNLSIDGKI LSDDCATLGT (SEQ ID NO: 345), LGVIPESVILLK ADEPIADYA AMDDVMQVCMPEEG-FKGTGLLGH (SEQ ID NO: 346), and/or KELKIQIM-HAFSVAPFDQ (SEQ ID NO: 339). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridize, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

The gene encoding the disclosed cDNA is believed to reside on chromosome 1. Accordingly, polynucleotides related to this invention are useful as a marker in linkage analysis for chromosome 1.

This gene is expressed in brain, lung cancer, bone marrow, tonsils and hematological tissues.

Polynucleotides and polypeptides of the invention are useful as reagents for differential identification of the tissue(s) or cell type(s) present in a biological sample and for diagnosis of diseases and conditions which include, but are not limited to, cancers, developmental and regulatory diseases of the brain and immune system. Similarly, polypeptides and antibodies directed to these polypeptides are useful in providing immunological probes for differential identification of the tissue(s) or cell type(s). For a number of disorders of the above tissues or cells, particularly of the brain and immune system, expression of this gene at significantly higher or lower levels may be routinely detected in certain tissues or cell types (e.g., cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 161 as residues: His-26 to Phe-31. Polynucleotides encoding said polypeptides are also encompassed by the invention.

The tissue distribution in brain indicates that polynucleotides and polypeptides corresponding to this gene are useful for the detection, treatment, and/or prevention of neurodegenerative disease states, behavioral disorders, or inflammatory conditions. Representative uses are described in the "Regeneration" and "Hyperproliferative Disorders" sections below, in Example 11, 15, 39, 41, 42, 43, and 51, and elsewhere herein.

Briefly, the uses include, but are not limited to the detection, treatment, and/or prevention of Alzheimer's Disease, Parkinson's Disease, Huntington's Disease, Tourette Syndrome, meningitis, encephalitis, demyelinating diseases, peripheral neuropathies, neoplasia, trauma, congenital malformations, spinal cord injuries, ischemia and infarction, aneurysms, hemorrhages, schizophrenia, mania, dementia, paranoia, obsessive compulsive disorder, depression, panic disorder, learning disabilities, ALS, psychoses, autism, and altered behaviors, including disorders in feeding, sleep patterns, balance, and perception. In addition, expression in T-cells and bone marrow, and homology to the mouse interferon-stimulated gene 15 and human calnexin proteins indicate that the protein product of this gene might also be useful for the diagnosis and treatment of immune disorders including: leukemias, lymphomas, auto-immunities, immunodeficiencies (e.g., AIDS), immuno-supressive conditions (transplantation) and hematopoeitic disorders. This gene product may be involved in the regulation of cytokine production, antigen presentation, or other processes suggests a usefulness in the treatment of general microbial infection, inflammation, and cancer (e.g., by boosting immune responses).

The tissue distribution in bone marrow, tonsils, and other immune tissues, indicates polynucleotides and polypeptides corresponding to this gene are useful for the diagnosis and treatment of a variety of immune system disorders. Representative uses are described in the "Immune Activity" and "Infectious Disease" sections below, in Example 11, 13, 14, 16, 18, 19, 20, 32, 33, 34, 53, and 58, and elsewhere herein. Briefly, the expression indicates a role in regulating the proliferation; survival; differentiation; and/or activation of hematopoietic cell lineages, including blood stem cells. Involvement in the regulation of cytokine production, antigen presentation, or other processes indicates a usefulness for treatment of cancer (e.g. by boosting immune responses).

Expression in cells of lymphoid origin, indicates the natural gene product would be involved in immune functions. Therefore it would also be useful as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersensitivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus erythematosis, drug induced hemolytic anemia, rheumatoid arthritis, Sjogren's disease, and scleroderma.

Moreover, the protein may represent a secreted factor that influences the differentiation or behavior of other blood cells, or that recruits hematopoietic cells to sites of injury. Thus, this gene product is thought to be useful in the expansion of stem cells and committed progenitors of various blood lineages, and in the differentiation and/or proliferation of various cell types.

Furthermore, the protein may also be used to determine biological activity, raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 29

Preferred polypeptides of the invention comprise, or alternatively consist of, an amino acid sequence selected from the group: RGERSEELLGREGLSGSQ (SEQ ID NO: 348), GGQDGHFTSTCVLALPRHAC HFW GSLGVTVTR-RAVQPRKSTLA LHSPNPSALQTQCSSILCCH-STLGHAMQMQLEQAPVYCSXRSPQRCILP HGN MGSTCPGNRWEGRGSCCPQAPATAASAS-VAGMVAVGV VVVVXVVRXVAGVVVVVEA-HIRHMRY VARMTVMVKDSQVAPPPEGPRLGPADS-VSPCSCTVPLHVTVLPSVEKAGGQQQQQQQDRHSST CDPSHEG CAPQEAQHLGAGQSLSAQQLLTPFSP-SAASAQPS QSLNFV (SEQ ID NO: 350), and/or AEAAE-GEKGVRS CWAERDCPAPRCWASWGAQPSWDGSQV-LLWRSCCCCCCWPPAFSTDGRTVTWRGTVQLQGET-ESAGPS LGPSGGGATWESFTITVILATYLMCRM-WASTTTTTPATXLTTXTTTTTPTATI-PATLAEAAVAGACGQQLPL PSHLFPGQVDPMF-PCGRMHLWGERXEQ (SEQ ID NO: 349). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridize, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

This gene is expressed in placenta, salivary gland, and colon.

Polynucleotides and polypeptides of the invention are useful as reagents for differential identification of the tissue(s) or cell type(s) present in a biological sample and for diagnosis of diseases and conditions which include, but are not limited to, developmental anomalies or fetal deficiencies and/or disorders of the colon. Similarly, polypeptides and antibodies directed to these polypeptides are useful in providing immunological probes for differential identification of the tissue(s) or cell type(s). For a number of disorders of the above tissues or cells, particularly of the developing fetus, expression of this gene at significantly higher or lower levels may be routinely detected in certain tissues or cell types (e.g., reproductive, and/or other tissues) or bodily fluids (e.g., lymph, serum, plasma, urine, synovial fluid and spinal fluid, amniotic fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 162 as residues: Gly-35 to Asp-40, Asn-51 to Trp-59. Polynucleotides encoding said polypeptides are also encompassed by the invention.

The tissue distribution in placenta indicates that polynucleotides and polypeptides corresponding to this gene are useful for the treatment and diagnosis of developmental anomalies or fetal deficiencies, reproductive dysfunction, as well as ovarian and other endometrial cancers.

Moreover, the expression within placenta and other cellular sources marked by proliferating cells indicates this protein may play a role in the regulation of cellular division, and may show utility in the diagnosis, treatment, and/or prevention of developmental diseases and disorders, including cancer, and other proliferative conditions. Representative uses are described in the "Hyperproliferative Disorders" and "Regeneration" sections below and elsewhere herein. Briefly, developmental tissues rely on decisions involving cell differentiation and/or apoptosis in pattern formation. Dysregulation of apoptosis can result in inappropriate suppression of cell death, as occurs in the development of some cancers, or in failure to control the extent of cell death, as is believed to occur in acquired immunodeficiency and certain degenerative disorders, such as spinal muscular atrophy (SMA).

Alternatively, this gene product may be involved in the pattern of cellular proliferation that accompanies early embryogenesis. Thus, aberrant expression of this gene product in tissues—particularly adult tissues—may correlate with patterns of abnormal cellular proliferation, such as found in various cancers. Because of potential roles in proliferation and differentiation, this gene product may have applications in the adult for tissue regeneration and the treatment of cancers. It may also act as a morphogen to control cell and tissue type specification. Therefore, the polynucleotides and polypeptides of the present invention are useful in treating, detecting, and/or preventing said disorders and conditions, in addition to other types of degenerative conditions. Thus this protein may modulate apoptosis or tissue differentiation and is useful in the detection, treatment, and/or prevention of degenerative or proliferative conditions and diseases. The protein is useful in modulating the immune response to aberrant polypeptides, as may exist in proliferating and cancerous cells and tissues. The protein can also be used to gain new insight into the regulation of cellular growth and proliferation.

Furthermore, the protein may also be used to determine biological activity, raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 30

This gene is expressed in cerebellum and ovarian cancer.

Preferred polypeptides of the present invention comprise, or alternatively consist of, one or more of the immunogenic epitopes shown in SEQ ID NO: 163 as residues: Thr-41 to Gly-47, Pro-170 to Asp-176, Leu-257 to Trp-262, Gln-276 to Ser-283, Arg-323 to Leu-330, Pro-409 to Ser-427, Gly 440 to Ala-449, Arg-323 to Gly-331, Glu-348 to Ser 354, Arg-256 to Trp-262, Phe 278 to Val 285, Arg 362 to Gly 385. Polynucleotides encoding said polypeptides are also encompassed by the invention. Antibodies that bind said epitopes or other polypeptides of the invention are also encompassed.

In a specific embodiment, polypeptides of the invention, comprise or alternatively consist of, an amino acid sequence selected from the group: FHGLGRLHTVHL (SEQ ID NO: 351), AAFTGLALLEQLDLSDNAQLR (SEQ ID NO: 352), HEVPDAPRPTPT (SEQ ID NO: 354), and/or AFRGLHSLD (SEQ ID NO: 353). Polynucleotides encoding these polypeptides are also encompassed by the invention as are antibodies that bind one or more of these polypeptides. Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides, or the complement there of are encompassed by the invention. Antibodies that bind polypeptides of the invention are also encompassed by the invention. Polynucleotides encoding these polypeptides are also encompassed by the invention.

Also preferred are polypeptides, comprising or alternatively consisting of, the mature polypeptide which is predicted to consist of residues 27-473 of the foregoing sequence (SEQ ID NO:163), and biologically active fragments of the mature polypeptide (e.g., fragments that prevent neural/neuronal damage and/or spinal cord injury). Polynucleotides encoding these polypeptides are also encompassed by the invention. Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides, or the complement there of are encompassed by the invention. Antibodies that bind polypeptides of the invention are also encompassed by the invention. Polynucleotides encoding these polypeptides are also encompassed by the invention.

In a nonexclusive specific embodiment, polypeptides of the invention, comprise or alternatively consist of, one or more of the following amino acid sequences and biologically active fragments thereof (e.g., fragments that prevent neural/neuronal damage and/or spinal cord injury).: SQRIFLHGNRISHVP AASFRAC (SEQ ID NO:537), LTILWLHSNVLARIDAAAFTGL (SEQ ID NO:538), LEQLDLSDNAQLRSVDPATFHGL (SEQ ID NO:539), LHTLHLDRC GLQELGPGLFRGL (SEQ ID NO:540), LQYLYLQDNALQALPDDTFRDL (SEQ ID NO:541), LTHLFLHGNRISSVPERAFRGL (SEQ ID NO:542), LDRLLLH QNRVAHVHPHAFRDL (SEQ ID NO:543), LMTLYLFANNLSALPTEALAPL (SEQ ID NO:544), AHCSAARGLRATR (SEQ ID NO:545), PAHCSAARGLRATRF (SEQ ID NO:546), PSLTCSLTPLGLALVLWTVLGPC (SEQ ID NO:547), LPSLTCSLTPLGLALVLWTVL (SEQ ID NO:548), LPSLTCSLTPLGLALVLWTVLGPC (SEQ ID NO:549), and CRNLTILWLHSNVL (SEQ ID NO:550). Polynucleotides encoding these polypeptides are also encompassed by the invention as are antibodies that bind one or more of these polypeptides. Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides, or the complement there of are encompassed by the invention. Antibodies that bind polypeptides of the invention are also encompassed by the invention. Polynucleotides encoding these polypeptides are also encompassed by the invention.

In a further embodiment of the invention, a Fc region of an immunoglobulin (e.g., IgG Fc) molecule is fused to one, two, three, four, five, six, seven, eight, nine, ten, eleven, twelve, thirteen, or all fourteen of the polypeptide(s) selected from the group consisting of: SQRIFLHGNRISHVPAASFRAC (SEQ ID NO:537), LTILWLHSNVLARIDAAAFTGL (SEQ ID NO:538), LEQLDLSDNAQLRS VDPATFHGL (SEQ ID NO:539), LHTLHLDRCGLQELGPGLFRGL (SEQ ID NO:540), LQYLYLQDNALQALPDDTFRDL (SEQ ID NO:541), LTHLFLH GNRISSVPERAFRGL (SEQ ID NO:542), LDRLLLHQNRVAHVHPHAFRDL (SEQ ID NO:543), LMTLYLFANNLSALPTEALAPL (SEQ ID NO:544), AHCSAARGLRATR (SEQ ID NO:545), PAHCSAARGLRATRF (SEQ ID NO:546), PSLTCSLTPLGLALVLWTVLGPC (SEQ ID NO:547), LPSLTCSLTPLGLALVLWTVL (SEQ ID NO:548), LPSLTCSLTPLGLALVLWTVLGPC (SEQ ID NO:549), and CRNLTILWLHSNVL (SEQ ID NO:550). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides, or the complement there of are encompassed by the invention. Antibodies that bind polypeptides of the invention are also encompassed by the invention. Polynucleotides encoding these polypeptides are also encompassed by the invention.

In additional embodiments, proteins comprising fragments or variants of a polypeptide of SEQ ID NO:163 (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides, or the complement there of) are fused to an Fc region of an immunoglobulin that bind the 66-amino acid extracellular loop of Nogo-A (See Genbank Accession CAB99248; GrandPre, T., et al., Nature, 403, pp. 439-444 (2000). Polynucleotides encoding these polypeptides are also encompassed by the invention, as are antibodies that bind one or more of these polypeptides.

Thus, the fragment, derivative or analog of the polypeptide of FIGS. 1A-C (SEQ ID NO:163), or that encoded by the deposited cDNA plasmid, may be (i) one in which one or more of the amino acid residues are substituted with a conserved or non-conserved amino acid residue (preferably a conserved amino acid residue) and such substituted amino acid residue may or may not be one encoded by the genetic code, or (ii) one in which one or more of the amino acid residues includes a substituent group, or (iii) one in which the extracellular domain of the polypeptide is fused with another compound, such as a compound to increase the half-life of the polypeptide (for example, polyethylene glycol), or (iv) one in which the additional amino acids are fused to the extracellular domain of the polypeptide, such as an IgG Fc fusion region peptide or leader or secretory sequence or a sequence which is employed for purification of the extracellular domain of the polypeptide or a proprotein sequence. Such fragments, derivatives and analogs are deemed to be within the scope of those skilled in the art from the teachings herein.

The present invention further includes compositions comprising the polypeptides of the present invention fused or conjugated to antibody domains other than the variable regions. For example, the polypeptides of the present invention may be fused or conjugated to an antibody Fc region, or portion thereof. The antibody portion fused to a polypeptide of the present invention may comprise the constant region, hinge region, CH1 domain, CH2 domain, and CH3 domain or any combination of whole domains or portions thereof. The polypeptides may also be fused or conjugated to the above antibody portions to form multimers. For example, Fc portions fused to the polypeptides of the present invention can form dimers through disulfide bonding between the Fc portions. Higher multimeric forms can be made by fusing the polypeptides to portions of IgA and IgM. Methods for fusing or conjugating the polypeptides of the present invention to antibody portions are known in the art. See, e.g., U.S. Pat. Nos. 5,336,603; 5,622,929; 5,359,046; 5,349,053; 5,447,851; 5,112,946; EP 307,434; EP 367,166; PCT publications WO 96/04388; WO 91/06570; Ashkenazi et al., Proc. Natl. Acad. Sci. USA 88:10535-10539 (1991); Zheng et al., J. Immunol. 154:5590-5600 (1995); and Vil et al., Proc. Natl. Acad. Sci. USA 89:11337-11341 (1992) (said references incorporated by reference in their entireties).

As one of skill in the art will appreciate, and as discussed above, the polypeptides of the present invention (e.g., those comprising an immunogenic or antigenic epitope) can be fused to heterologous polypeptide sequences. For example, polypeptides of the present invention (including fragments or variants thereof), may be fused with the constant domain of immunoglobulins (IgA, IgE, IgG, IgM), or portions thereof (CH1, CH2, CH3, or any combination thereof and portions thereof, resulting in chimeric polypeptides. By way of another non-limiting example, polypeptides and/or antibodies of the present invention (including fragments or variants thereof) may be fused with albumin (including but not limited to recombinant human serum albumin or fragments or variants thereof (see, e.g., U.S. Pat. No. 5,876,969, issued Mar. 2, 1999, EP Patent 0 413 622, and U.S. Pat. No. 5,766,883, issued Jun. 16, 1998, herein incorporated by reference in their entirety)). In a preferred embodiment, polypeptides and/or antibodies of the present invention (including fragments or variants thereof) are fused with the mature form of human serum albumin (i.e., amino acids 1-585 of human serum albumin as shown in FIGS. 1 and 2 of EP Patent 0 322 094) which is herein incorporated by reference in its entirety. In another preferred embodiment, polypeptides and/or antibodies of the present invention (including fragments or variants thereof) are fused with polypeptide fragments comprising, or alternatively consisting of, amino acid residues 1-z of human serum albumin, where z is an integer from 369 to 419, as described in U.S. Pat. No. 5,766,883 herein incorporated by reference in its entirety. Polypeptides and/or antibodies of the present invention (including fragments or variants thereof) may be fused to either the N- or C-terminal end of the heterologous protein (e.g., immunoglobulin Fc polypeptide or human serum albumin polypeptide). Polynucleotides encoding fusion proteins of the invention are also encompassed by the invention.

Such fusion proteins as those described above may facilitate purification and may increase half-life in vivo. This has been shown for chimeric proteins consisting of the first two domains of the human CD4-polypeptide and various domains of the constant regions of the heavy or light chains of mammalian immunoglobulins. See, e.g., EP 394,827; Traunecker et al., Nature, 331:84-86 (1988). Enhanced delivery of an antigen across the epithelial barrier to the immune system has been demonstrated for antigens (e.g., insulin) conjugated to an FcRn binding partner such as IgG or Fc fragments (see, e.g., PCT Publications WO 96/22024 and WO 99/04813). IgG Fusion proteins that have a disulfide-linked dimeric structure due to the IgG portion desulfide bonds have also been found to be more efficient in binding and neutralizing other molecules than monomeric polypeptides or fragments thereof alone. See, e.g., Fountoulakis et al., J. Biochem., 270:3958-3964 (1995). Nucleic acids encoding the above epitopes can also be recombined with a gene of interest as an epitope tag (e.g., the hemagglutinin (OHM) tag or flag tag) to aid in detection and purification of the expressed polypeptide. For example, a system described by Janknecht et al. allows for the ready purification of non-denatured fusion proteins expressed in human cell lines (Janknecht et al., 1991, Proc. Natl. Acad. Sci. USA 88:8972-897). In this system, the gene of interest is subcloned into a vaccinia recombination plasmid such that the open reading frame of the gene is translationally fused to an amino-terminal tag consisting of six histidine residues. The tag serves as a matrix binding domain for the fusion protein. Extracts from cells infected with the recombinant vaccinia virus are loaded onto Ni2+ nitriloacetic acid-agarose column and histidine-tagged proteins can be selectively eluted with imidazole-containing buffers.

FIGS. 1A-C show the nucleotide (SEQ ID NO:40) and deduced amino acid sequence (SEQ ID NO:163) corresponding to this gene.

FIG. 2 shows an analysis of the amino acid sequence (SEQ ID NO:163). Alpha, beta, turn and coil regions; hydrophilicity and hydrophobicity; amphipathic regions; flexible regions; antigenic index and surface probability are shown, and all were generated using the default settings of the recited computer algorithyms. In the "Antigenic Index or Jameson-Wolf" graph, the positive peaks indicate locations of the highly antigenic regions of the protein, i.e., regions from which epitope-bearing peptides of the invention can be obtained. Polypeptides comprising, or alternatively consisting of, domains defined by these graphs are contemplated by the present invention, as are polynucleotides encoding these polypeptides.

The data presented in FIG. 2 are also represented in tabular form in Table 6. The columns are labeled with the headings "Res", "Position", and Roman Numerals I-XIV. The column headings refer to the following features of the amino acid sequence presented in FIG. 2, and Table 6: "Res": amino acid residue of SEQ ID NO:534 and FIGS. 1A-1C; "Position": position of the corresponding residue within SEQ ID NO:534 and FIGS. 1A-1C; I: Alpha, Regions—Garnier-Robson; II: Alpha, Regions—Chou-Fasman; III: Beta, Regions—Garnier-Robson; IV: Beta, Regions—Chou-Fasman; V: Turn, Regions—Garnier-Robson; VI: Turn, Regions—Chou-Fasman; VII: Coil, Regions—Garnier-Robson; VIII: Hydrophilicity Plot—Kyte-Doolittle; IX: Hydrophobicity Plot—Hopp-Woods; X: Alpha, Amphipathic Regions—Eisenberg; XI: Beta, Amphipathic Regions—Eisenberg; XII: Flexible Regions—Karplus-Schulz; XIII: Antigenic Index—Jameson-Wolf; and XIV: Surface Probability Plot—Emini.

Preferred embodiments of the invention in this regard include fragments that comprise, or alternatively consisting of, one or more of the following regions: alpha-helix and alpha-helix forming regions ("alpha-regions"), beta-sheet and beta-sheet forming regions ("beta-regions"), turn and turn-forming regions ("turn-regions"), coil and coil-forming regions ("coil-regions"), hydrophilic regions, hydrophobic regions, alpha amphipathic regions, beta amphipathic regions, flexible regions, surface-forming regions and high antigenic index regions. The data representing the structural or functional attributes of the protein set forth in FIG. 2 and/or Table 6, as described above, was generated using the various modules and algorithms of the DNA*STAR set on default parameters. In a preferred embodiment, the data presented in columns VIII, IX, XIII, and XIV of Table 6 can be used to determine regions of the protein which exhibit a high degree of potential for antigenicity. Regions of high antigenicity are determined from the data presented in columns VIII, IX, XIII, and/or XIV by choosing values which represent regions of the polypeptide which are likely to be exposed on the surface of the polypeptide in an environment in which antigen recognition may occur in the process of initiation of an immune response.

Certain preferred regions in these regards are set out in FIG. 2, but may, as shown in Table 6, be represented or identified by using tabular representations of the data presented in FIG. 2. The DNA*STAR computer algorithm used to generate FIG. 2 (set on the original default parameters) was used to present the data in FIG. 2 in a tabular format (See Table 6). The tabular format of the data in FIG. 2 is used to easily determine specific boundaries of a preferred region.

The present invention is further directed to fragments of the polynucleotide sequences described herein. By a fragment of, for example, the polynucleotide sequence of a deposited cDNA or the nucleotide sequence shown in SEQ ID NO: 533, is intended polynucleotide fragments at least about 15 nt, and more preferably at least about 20 nt, at least about 25 nt, still more preferably at least about 30 nt, at least about 35 nt, and even more preferably, at least about 40 nt in length, at least about 45 nt in length, at least about 50 nt in length, at least about 60 nt in length, at least about 70 nt in length, at least about 80 nt in length, at least about 90 nt in length, at least about 100 nt in length, at least about 125 nt in length, at least about 150 nt in length, at least about 175 nt in length, which are useful as diagnostic probes and primers as discussed herein. Of course, larger fragments 200-1500 nt in length are also useful according to the present invention, as are fragments corresponding to most, if not all, of the nucleotide sequence of a deposited cDNA or as shown in SEQ ID NO:533. By a fragment at least 20 nt in length, for example, is intended fragments which include 20 or more contiguous bases from the nucleotide sequence of a deposited cDNA or the nucleotide sequence as shown in SEQ ID NO:533. In this context "about" includes the particularly recited size, an sizes larger or smaller by several (5, 4, 3, 2, or 1) nucleotides, at either terminus or at both termini. Representative examples of polynucleotide fragments of the invention include, for example, fragments that comprise, or alternatively, consist of, a sequence from about nucleotide 1 to about 50, from about 51 to about 100, from about 101 to about 150, from about 151 to about 200, from about 201 to about 250, from about 251 to about 300, from about 301 to about 350, from about 351 to about 400, from about 401 to about 450, from about 451 to about 500, and from about 501 to about 550, and from about 551 to about 600, from about 601 to about 650, from about 651 to about 700, from about 701 to about 750, from about 751 to about 800, from about 801 to about 850, from about 851 to about 900, from about 901 to about 950, from about 951 to about 1000, from about 1001 to about 1050, from about 1051 to about 1100, from about 1101 to about 1150 from about 1151 to about 1200, from about 1201 to about 1250, from about 1251 to about 1300, from about 1301 to about 1350, from about 1351 to about 1400, from about 1401 to about 1450, and from about 1451 to about 1500, from about 1501 to about 1550, from about 1551 to about 1600, from about 1601 to about 1650 from about 1651 to about 1700, from about 1701 to about 1750, from about 1751 to about 1777 of SEQ ID NO:533, or the complementary strand thereto, or the cDNA contained in a deposited clone. In this context "about" includes the particularly recited ranges, and ranges larger or smaller by several (5, 4, 3, 2, or 1) nucleotides, at either terminus or at both termini. In additional embodiments, the polynucleotides of the invention encode functional attributes of the corresponding protein.

Preferred polypeptide fragments of the invention comprise, or alternatively consist of, the secreted protein having a continuous series of deleted residues from the amino or the carboxy terminus, or both. Particularly, N-terminal deletions of the polypeptide can be described by the general formula m-473 where m is an integer from 2 to 467, where m corresponds to the position of the amino acid residue identified in SEQ ID NO:163. More in particular, the invention provides polynucleotides encoding polypeptides comprising, or alternatively consisting of, an amino acid sequence selected from the group: K-2 to C-473; R-3 to C-473; A-4 to C-473; S-5 to C-473; A-6 to C-473; G-7 to C-473; G-8 to C-473; S-9 to C-473; R-10 to C-473; L-11 to C-473; L-12 to C-473; A-13 to C-473; W-14 to C-473; V-15 to C-473; L-16 to C-473; W-17 to C-473; L-18 to C-473; Q-19 to C-473; A-20 to C-473; W-21 to C-473; Q-22 to C-473; V-23 to C-473; A-24 to C-473; A-25 to C-473; P-26 to C-473; C-27 to C-473; P-28 to C-473; G-29 to C-473; A-30 to C-473; C-31 to C-473; V-32 to C-473; C-33 to C-473; Y-34 to C-473; N-35 to C-473; E-36 to C-473; P-37 to C-473; K-38 to C-473; V-39 to C-473; T-40 to C-473; T-41 to C-473; S-42 to C-473; C-43 to C-473; P-44 to C-473; Q-45 to C-473; Q-46 to C-473; G-47 to C-473; L-48 to C-473; Q-49 to C-473; A-50 to C-473; V-51 to C-473; P-52 to C-473; V-53 to C-473; G-54 to C-473; I-55 to C-473; P-56 to C-473; A-57 to C-473; A-58 to C-473; S-59 to C-473; Q-60 to C-473; R-61 to C-473; I-62 to C-473; F-63 to C-473; L-64 to C-473; H-65 to C-473; G-66 to C-473; N-67 to C-473; R-68 to C-473; I-69 to C-473; S-70 to C-473; H-71 to C-473; V-72 to C-473; P-73 to C-473; A-74 to C-473; A-75 to C-473; S-76 to C-473; F-77 to C-473; R-78 to C-473; A-79 to C-473; C-80 to C-473; R-81 to C-473; N-82 to C-473; L-83 to C-473; T-84 to C-473; I-85 to C-473; L-86 to C-473; W-87 to C-473; L-88 to C-473; H-89 to C-473; S-90 to C-473; N-91 to C-473; V-92 to C-473; L-93 to C-473; A-94 to C-473; R-95 to C-473; I-96 to C-473; D-97 to C-473; A-98 to C-473; A-99 to C-473; A-100 to C-473; F-101 to C-473; T-102 to C-473; G-103 to C-473; L-104 to C-473; A-105 to C-473; L-106 to C-473; L-107 to C-473; E-108 to C-473; Q-109 to C-473; L-110 to C-473; D-111 to C-473; L-112 to C-473; S-113 to C-473; D-114 to C-473; N-115 to C-473; A-116 to C-473; Q-117 to C-473; L-118 to C-473; R-119 to C-473; S-120 to C-473; V-121 to C-473; D-122 to C-473; P-123 to C-473; A-124 to C-473; T-125 to C-473; F-126 to C-473; H-127 to C-473; G-128 to C-473; L-129 to C-473; G-130 to C-473; R-131 to C-473; L-132 to C-473; H-133 to C-473; T-134 to C-473; L-135 to C-473; H-136 to C-473; L-137 to C-473; D-138 to C-473; R-139 to C-473; C-140 to C-473; G-141 to C-473; L-142 to C-473; Q-143 to C-473; E-144 to C-473; L-145 to C-473; G-146 to C-473; P-147 to C-473; G-148 to C-473; L-149 to C-473; F-150 to C-473; R-151 to C-473; G-152 to C-473; L-153 to C-473; A-154 to C-473; A-155 to C-473; L-156 to C-473; Q-157 to C-473; Y-158 to C-473; L-159 to C-473; Y-160 to C-473; L-161 to C-473; Q-162 to C-473; D-163 to C-473; N-164 to C-473; A-165 to C-473; L-166 to C-473; Q-167 to C-473; A-168 to C-473; L-169 to C-473; P-170 to C-473; D-171 to C-473; D-172 to C-473; T-173 to C-473; F-174 to C-473; R-175 to C-473; D-176 to C-473; L-177 to C-473; G-178 to C-473; N-179 to C-473; L-180 to C-473; T-181 to C-473; H-182 to C-473; L-183 to C-473; F-184 to C-473; L-185 to C-473; H-186 to C-473; G-187 to C-473; N-188 to C-473; R-189 to C-473; I-190 to C-473; S-191 to C-473; S-192 to C-473; V-193 to C-473; P-194 to C-473; E-195 to C-473; R-196 to C-473; A-197 to C-473; F-198 to C-473; R-199 to C-473; G-200 to C-473; L-201 to C-473; H-202 to C-473; S-203 to C-473; L-204 to C-473; D-205 to C-473; R-206 to C-473; L-207 to C-473; L-208 to C-473; L-209 to C-473; H-210 to C-473; Q-211 to C-473; N-212 to C-473; R-213 to C-473; V-214 to C-473; A-215 to C-473; H-216 to C-473; V-217 to C-473; H-218 to C-473; P-219 to C-473; H-220 to C-473; A-221 to C-473; F-222 to C-473; R-223 to C-473; D-224 to C-473; L-225 to C-473; G-226 to C-473; R-227 to C-473; L-228 to C-473; M-229 to C-473; T-230 to C-473; L-231 to C-473; Y-232 to C-473; L-233 to C-473; F-234 to C-473; A-235 to C-473; N-236 to C-473; N-237 to C-473; L-238 to C-473; S-239 to C-473; A-240 to C-473; L-241 to C-473; P-242 to C-473; T-243 to C-473; E-244 to C-473; A-245 to C-473; L-246 to C-473; A-247 to C-473; P-248 to C-473; L-249 to C-473; R-250 to C-473; A-251 to C-473; L-252 to C-473; Q-253 to C-473; Y-254 to C-473; L-255 to C-473; R-256 to C-473; L-257 to C-473; N-258 to C-473; D-259 to C-473; N-260 to C-473; P-261 to C-473; W-262 to C-473; V-263 to C-473; C-264 to C-473; D-265 to C-473; C-266 to C-473; R-267 to C-473; A-268 to C-473; R-269 to C-473; P-270 to C-473; L-271 to C-473; W-272 to C-473; A-273 to C-473; W-274 to C-473; L-275 to C-473; Q-276 to C-473; K-277 to C-473; F-278 to C-473; R-279 to C-473; G-280 to C-473; S-281 to C-473; S-282 to C-473; S-283 to C-473; E-284 to C-473; V-285 to C-473; P-286 to C-473; C-287 to C-473; S-288 to C-473; L-289 to C-473; P-290 to C-473; Q-291 to C-473; R-292 to C-473; L-293 to C-473; A-294 to C-473; G-295 to C-473; R-296 to C-473; D-297 to C-473; L-298 to C-473; K-299 to C-473; R-300 to C-473; L-301 to C-473; A-302 to C-473; A-303 to C-473; N-304 to C-473; D-305 to C-473; L-306 to C-473; Q-307 to C-473; G-308 to C-473; C-309 to C-473; A-310 to C-473; V-311 to C-473; A-312 to C-473; T-313 to C-473; G-314 to C-473; P-315 to C-473; Y-316 to C-473; H-317 to C-473; P-318 to C-473; I-319 to C-473; W-320 to C-473; T-321 to C-473; G-322 to C-473; R-323 to C-473; A-324 to C-473; T-325 to C-473; D-326 to C-473; E-327 to C-473; E-328 to C-473; P-329 to C-473; L-330 to C-473; G-331 to C-473; L-332 to C-473; P-333 to C-473; K-334 to C-473; C-335 to C-473; C-336 to C-473; Q-337 to C-473; P-338 to C-473; D-339 to C-473; A-340 to C-473; A-341 to C-473; D-342 to C-473; K-343 to C-473; A-344 to C-473; S-345 to C-473; V-346 to C-473; L-347 to C-473; E-348 to C-473; P-349 to C-473; G-350 to C-473; R-351 to C-473; P-352 to C-473; A-353 to C-473; S-354 to C-473; A-355 to C-473; G-356 to C-473; N-357 to C-473; A-358 to C-473; L-359 to C-473; K-360 to C-473; G-361 to C-473; R-362 to C-473; V-363 to C-473; P-364 to C-473; P-365 to C-473; G-366 to C-473; D-367 to C-473; S-368 to C-473; P-369 to C-473; P-370 to C-473; G-371 to C-473; N-372 to C-473; G-373 to C-473; S-374 to C-473; G-375 to C-473; P-376 to C-473; R-377 to C-473; H-378 to C-473; I-379 to C-473; N-380 to C-473; D-381 to C-473; S-382 to C-473; P-383 to C-473; F-384 to C-473; G-385 to C-473; T-386 to C-473; L-387 to C-473; P-388 to C-473; G-389 to C-473; S-390 to C-473; A-391 to C-473; E-392 to C-473; P-393 to C-473; P-394 to C-473; A-395 to C-473; H-396 to C-473; C-397 to C-473; S-398 to C-473; A-399 to C-473; A-400 to C-473; R-401 to C-473; G-402 to C-473; L-403 to C-473; R-404 to C-473; A-405 to C-473; T-406 to C-473; R-407 to C-473; F-408 to C-473; P-409 to C-473; T-410 to C-473; S-411 to C-473; G-412 to C-473; P-413 to C-473; R-414 to C-473; R-415 to C-473; R-416 to C-473; P-417 to C-473; G-418 to C-473; C-419 to C-473; S-420 to C-473; R-421 to C-473; K-422 to C-473; N-423 to C-473; R-424 to C-473; T-425 to C-473; R-426 to C-473; S-427 to C-473; H-428 to C-473; C-429 to C-473; R-430 to C-473; L-431 to C-473; G-432 to C-473; Q-433 to C-473; A-434 to C-473; G-435 to C-473; S-436 to C-473; G-437 to C-473; G-438 to C-473; G-439 to C-473; G-440 to C-473; T-441 to C-473; G-442 to C-473; D-443 to C-473; S-444 to C-473; E-445 to C-473; G-446 to C-473; S-447 to C-473; G-448 to C-473; A-449 to C-473; L-450 to C-473; P-451 to C-473; S-452 to C-473; L-453 to C-473; T-454 to C-473; C-455 to C-473; S-456 to C-473; L-457 to C-473; T-458 to C-473; P-459 to C-473; L-460 to C-473; G-461 to C-473; L-462 to C-473; A-463 to C-473; L-464 to C-473; V-465 to C-473; L-466 to C-473; W-467 to C-473; and T-468 to C-473 of SEQ ID NO: 163. Polypeptides encoded by these polynucleotides are also encompassed by the invention. Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides, or the complement there of are encompassed by the invention. Antibodies that bind polypeptides of the invention are also encompassed by the invention. Polynucleotides encoding these polypeptides are also encompassed by the invention.

Also as mentioned above, even if deletion of one or more amino acids from the C-terminus of a protein results in modification of loss of one or more biological functions of the protein (e.g., modulation of neurite growth, including, but not limited to, inhibitory activity and/or antiinflammatory activity), other functional activities (e.g., biological activities, ability to multimerize, ability to bind ligand, ability to generate antibodies, ability to bind antibodies) may still be retained. For example the ability of the shortened polypeptide to induce and/or bind to antibodies which recognize the complete or mature forms of the polypeptide generally will be retained when less than the majority of the residues of the complete or mature polypeptide are removed from the C-terminus. Whether a particular polypeptide lacking C-terminal residues of a complete polypeptide retains such immunologic activities can readily be determined by routine methods described herein and otherwise known in the art. It is not unlikely that a polypeptide with a large number of deleted C-terminal amino acid residues may retain some biological or immunogenic activities. In fact, peptides composed of as few as six amino acid residues may often evoke an immune response.

Accordingly, the present invention further provides polypeptides having one or more residues deleted from the carboxy terminus of the amino acid sequence of the polypeptide shown in FIGS. 1A-C (SEQ ID NO:163), as described by the general formula I-n, where n is an integer from 6 to 472, where n corresponds to the position of the amino acid residue identified in SEQ ID NO:163. More in particular, the invention provides polynucleotides encoding polypeptides comprising, or alternatively consisting of, an amino acid sequence selected from the group: M-1 to P-472; M-1 to G-471; M-1 to L-470; M-1 to V-469; M-1 to T-468; M-1 to W-467; M-1 to L-466; M-1 to V-465; M-1 to L-464; M-1 to A-463; M-1 to L-462; M-1 to G-461; M-1 to L-460; M-1 to P-459; M-1 to T-458; M-1 to L-457; M-1 to S-456; M-1 to C-455; M-1 to T-454; M-1 to L-453; M-1 to S-452; M-1 to P-451; M-1 to L-450; M-1 to A-449; M-1 to G-448; M-1 to S-447; M-1 to G-446; M-1 to E-445; M-1 to S-444; M-1 to D-443; M-1 to G-442; M-1 to T-441; M-1 to G-440; M-1 to G-439; M-1 to G-438; M-1 to G-437; M-1 to S-436; M-1 to G-435; M-1 to A-434; M-1 to Q-433; M-1 to G-432; M-1 to L-431; M-1 to R-430; M-1 to C-429; M-1 to H-428; M-1 to S-427; M-1 to R-426; M-1 to T-425; M-1 to R-424; M-1 to N-423; M-1 to K-422; M-1 to R-421; M-1 to S-420; M-1 to C-419; M-1 to G-418; M-1 to P-417; M-1 to R-416; M-1 to R-415; M-1 to R-414; M-1 to P-413; M-1 to G-412; M-1 to S-411; M-1 to T-410; M-1 to P-409; M-1 to F-408; M-1 to R-407; M-1 to T-406; M-1 to A-405; M-1 to R-404; M-1 to L-403; M-1 to G-402; M-1 to R-401; M-1 to A-400; M-1 to A-399; M-1 to S-398; M-1 to C-397; M-1 to H-396; M-1 to A-395; M-1 to P-394; M-1 to P-393; M-1 to E-392; M-1 to A-391; M-1 to S-390; M-1 to G-389; M-1 to P-388; M-1 to L-387; M-1 to T-386; M-1 to G-385; M-1 to F-384; M-1 to P-383; M-1 to S-382; M-1 to D-381; M-1 to N-380; M-1 to 1-379; M-1 to H-378; M-1 to R-377; M-1 to P-376; M-1 to G-375; M-1 to S-374; M-1 to G-373; M-1 to N-372; M-1 to G-371; M-1 to P-370; M-1 to P-369; M-1 to S-368; M-1 to D-367; M-1 to G-366; M-1 to P-365; M-1 to P-364; M-1 to V-363; M-1 to R-362; M-1 to G-361; M-1 to K-360; M-1 to L-359; M-1 to A-358; M-1 to N-357; M-1 to G-356; M-1 to A-355; M-1 to S-354; M-1 to A-353; M-1 to P-352; M-1 to R-351; M-1 to G-350; M-1 to P-349; M-1 to E-348; M-1 to L-347; M-1 to V-346; M-1 to S-345; M-1 to A-344; M-1 to K-343; M-1 to D-342; M-1 to A-341; M-1 to A-340; M-1 to D-339; M-1 to P-338; M-1 to Q-337; M-1 to C-336; M-1 to C-335; M-1 to K-334; M-1 to P-333; M-1 to L-332; M-1 to G-331; M-1 to L-330; M-1 to P-329; M-1 to E-328; M-1 to E-327; M-1 to D-326; M-1 to T-325; M-1 to A-324; M-1 to R-323; M-1 to G-322; M-1 to T-321; M-1 to W-320; M-1 to 1-319; M-1 to P-318; M-1 to H-317; M-1 to Y-316; M-1 to P-315; M-1 to G-314; M-1 to T-313; M-1 to A-312; M-1 to V-311; M-1 to A-310; M-1 to C-309; M-1 to G-308; M-1 to Q-307; M-1 to L-306; M-1 to D-305; M-1 to N-304; M-1 to A-303; M-1 to A-302; M-1 to L-301; M-1 to R-300; M-1 to K-299; M-1 to L-298; M-1 to D-297; M-1 to R-296; M-1 to G-295; M-1 to A-294; M-1 to L-293; M-1 to R-292; M-1 to Q-291; M-1 to P-290; M-1 to L-289; M-1 to S-288; M-1 to C-287; M-1 to P-286; M-1 to V-285; M-1 to E-284; M-1 to S-283; M-1 to S-282; M-1 to S-281; M-1 to G-280; M-1 to R-279; M-1 to F-278; M-1 to K-277; M-1 to Q-276; M-1 to L-275; M-1 to W-274; M-1 to A-273; M-1 to W-272; M-1 to L-271; M-1 to P-270; M-1 to R-269; M-1 to A-268; M-1 to R-267; M-1 to C-266; M-1 to D-265; M-1 to C-264; M-1 to V-263; M-1 to W-262; M-1 to P-261; M-1 to N-260; M-1 to D-259; M-1 to N-258; M-1 to L-257; M-1 to R-256; M-1 to L-255; M-1 to Y-254; M-1 to Q-253; M-1 to L-252; M-1 to A-251; M-1 to R-250; M-1 to L-249; M-1 to P-248; M-1 to A-247; M-1 to L-246; M-1 to A-245; M-1 to E-244; M-1 to T-243; M-1 to P-242; M-1 to L-241; M-1 to A-240; M-1 to S-239; M-1 to L-238; M-1 to N-237; M-1 to N-236; M-1 to A-235; M-1 to F-234; M-1 to L-233; M-1 to Y-232; M-1 to L-231; M-1 to T-230; M-1 to M-229; M-1 to L-228; M-1 to R-227; M-1 to G-226; M-1 to L-225; M-1 to D-224; M-1 to R-223; M-1 to F-222; M-1 to A-221; M-1 to H-220; M-1 to P-219; M-1 to H-218; M-1 to V-217; M-1 to H-216; M-1 to A-215; M-1 to V-214; M-1 to R-213; M-1 to N-212; M-1 to Q-211; M-1 to H-210; M-1 to L-209; M-1 to L-208; M-1 to L-207; M-1 to R-206; M-1 to D-205; M-1 to L-204; M-1 to S-203; M-1 to H-202; M-1 to L-201; M-1 to G-200; M-1 to R-199; M-1 to F-198; M-1 to A-197; M-1 to R-196; M-1 to E-195; M-1 to P-194; M-1 to V-193; M-1 to S-192; M-1 to S-191; M-1 to 1-190; M-1 to R-189; M-1 to N-188; M-1 to G-187; M-1 to H-186; M-1 to L-185; M-1 to F-184; M-1 to L-183; M-1 to H-182; M-1 to T-181; M-1 to L-180; M-1 to N-179; M-1 to G-178; M-1 to L-177; M-1 to D-176; M-1 to R-175; M-1 to F-174; M-1 to T-173; M-1 to D-172; M-1 to D-171; M-1 to P-170; M-1 to L-169; M-1 to A-168; M-1 to Q-167; M-1 to L-166; M-1 to A-165; M-1 to N-164; M-1 to D-163; M-1 to Q-162; M-1 to L-161; M-1 to Y-160; M-1 to L-159; M-1 to Y-158; M-1 to Q-157; M-1 to L-156; M-1 to A-155; M-1 to A-154; M-1 to L-153; M-1 to G-152; M-1 to R-151; M-1 to F-150; M-1 to L-149; M-1 to G-148; M-1 to P-147; M-1 to G-146; M-1 to L-145; M-1 to E-144; M-1 to Q-143; M-1 to L-142; M-1 to G-141; M-1 to C-140; M-1 to R-139; M-1 to D-138; M-1 to L-137; M-1 to H-136; M-1 to L-135; M-1 to T-134; M-1 to H-133; M-1 to L-132; M-1 to R-131; M-1 to G-130; M-1 to L-129; M-1 to G-128; M-1 to H-127; M-1 to F-126; M-1 to T-125; M-1 to A-124; M-1 to P-123; M-1 to D-122; M-1 to V-121; M-1 to S-120; M-1 to R-119; M-1 to L-118; M-1 to Q-117; M-1 to A-116; M-1 to N-115; M-1 to D-114; M-1 to S-113; M-1 to L-112; M-1 to D-111; M-1 to L-110; M-1 to Q-109; M-1 to E-108; M-1 to L-107; M-1 to L-106; M-1 to A-105; M-1 to L-104; M-1 to G-103; M-1 to T-102; M-1 to F-101; M-1 to A-100; M-1 to A-99; M-1 to A-98; M-1 to D-97; M-1 to 1-96; M-1 to R-95; M-1 to A-94; M-1 to L-93; M-1 to V-92; M-1 to N-91; M-1 to S-90; M-1 to H-89; M-1 to L-88; M-1 to W-87; M-1 to L-86; M-1 to 1-85; M-1 to T-84; M-1 to L-83; M-1 to N-82; M-1 to R-81; M-1 to C-80; M-1 to A-79; M-1 to R-78; M-1 to F-77; M-1 to S-76; M-1 to A-75; M-1 to A-74; M-1 to P-73; M-1 to V-72; M-1 to H-71; M-1 to S-70; M-1 to 1-69; M-1 to R-68; M-1 to N-67; M-1 to G-66; M-1 to H-65; M-1 to L-64; M-1 to F-63; M-1 to 1-62; M-1 to R-61; M-1 to Q-60; M-1 to S-59; M-1 to A-58; M-1 to A-57; M-1 to P-56; M-1 to 1-55; M-1 to G-54; M-1 to V-53; M-1 to P-52; M-1 to V-51; M-1 to A-50; M-1 to Q-49; M-1 to L-48; M-1 to G-47; M-1 to Q-46; M-1 to Q-45; M-1 to P-44; M-1 to C-43; M-1 to S-42; M-1 to T-41; M-1 to T-40; M-1 to V-39; M-1 to K-38; M-1 to P-37; M-1 to E-36; M-1 to N-35; M-1 to Y-34; M-1 to C-33; M-1 to V-32; M-1 to C-31; M-1 to A-30; M-1 to G-29; M-1 to P-28; M-1 to C-27; M-1 to P-26; M-1 to A-25; M-1 to A-24; M-1 to V-23; M-1 to Q-22; M-1 to W-21; M-1 to A-20; M-1 to Q-19; M-1 to L-18; M-1 to W-17; M-1 to L-16; M-1 to V-15; M-1 to W-14; M-1 to A-13; M-1 to L-12; M-1 to L-11; M-1 to R-10; M-1 to S-9; M-1 to G-8; M-1 to G-7; and M-1 to A-6 of SEQ ID NO:163. Polypeptides encoded by these polynucleotides are also encompassed by the invention. Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides, or the complement there of are encompassed by the invention. Antibodies that bind polypeptides of the invention are also encompassed by the invention. Polynucleotides encoding these polypeptides are also encompassed by the invention.

In addition, any of the above listed N- or C-terminal deletions can be combined to produce a N- and C-terminal deleted polypeptide. The invention also provides polypeptides comprising, or alternatively consisting of, one or more amino acids deleted from both the amino and the carboxyl termini, which may be described generally as having residues m-n of SEQ ID NO:163, where n and m are integers as described above. More in particular, the invention provides polynucleotides encoding polypeptides comprising, or alternatively consisting of, an amino acid sequence selected from the group: M-1 to V-15; K-2 to L-16; R-3 to W-17; A-4 to L-18; S-5 to Q-19; A-6 to A-20; G-7 to W-21; G-8 to Q-22; S-9 to V-23; R-10 to A-24; L-11 to A-25; L-12 to P-26; A-13 to C-27; W-14 to P-28; V-15 to G-29; L-16 to A-30; W-17 to C-31; L-18 to V-32; Q-19 to C-33; A-20 to Y-34; W-21 to N-35; Q-22 to E-36; V-23 to P-37; A-24 to K-38; A-25 to V-39; P-26 to T-40; C-27 to T-41; P-28 to S-42; G-29 to C-43;

A-30 to P-44; C-31 to Q-45; V-32 to Q-46; C-33 to G-47; Y-34 to L-48; N-35 to Q-49; E-36 to A-50; P-37 to V-51; K-38 to P-52; V-39 to V-53; T-40 to G-54; T-41 to 1-55; S-42 to P-56; C-43 to A-57; P-44 to A-58; Q-45 to S-59; Q-46 to Q-60; G-47 to R-61; L-48 to 1-62; Q-49 to F-63; A-50 to L-64; V-51 to H-65; P-52 to G-66; V-53 to N-67; G-54 to R-68; I-55 to 1-69; P-56 to S-70; A-57 to H-71; A-58 to V-72; S-59 to P-73; Q-60 to A-74; R-61 to A-75; I-62 to S-76; F-63 to F-77; L-64 to R-78; H-65 to A-79; G-66 to C-80; N-67 to R-81; R-68 to N-82; I-69 to L-83; S-70 to T-84; H-71 to 1-85; V-72 to L-86; P-73 to W-87; A-74 to L-88; A-75 to H-89; S-76 to S-90; F-77 to N-91; R-78 to V-92; A-79 to L-93; C-80 to A-94; R-81 to R-95; N-82 to 1-96; L-83 to D-97; T-84 to A-98; I-85 to A-99; L-86 to A-100; W-87 to F-101; L-88 to T-102; H-89 to G-103; S-90 to L-104; N-91 to A-105; V-92 to L-106; L-93 to L-107; A-94 to E-108; R-95 to Q-109; I-96 to L-110; D-97 to D-111; A-98 to L-112; A-99 to S-113; A-100 to D-114; F-101 to N-115; T-102 to A-116; G-103 to Q-117; L-104 to L-118; A-105 to R-119; L-106 to S-120; L-107 to V-121; E-108 to D-122; Q-109 to P-123; L-110 to A-124; D-111 to T-125; L-112 to F-126; S-113 to H-127; D-114 to G-128; N-115 to L-129; A-116 to G-130; Q-117 to R-131; L-118 to L-132; R-119 to H-133; S-120 to T-134; V-121 to L-135; D-122 to H-136; P-123 to L-137; A-124 to D-138; T-125 to R-139; F-126 to C-140; H-127 to G-141; G-128 to L-142; L-129 to Q-143; G-130 to E-144; R-131 to L-145; L-132 to G-146; H-133 to P-147; T-134 to G-148; L-135 to L-149; H-136 to F-150; L-137 to R-151; D-138 to G-152; R-139 to L-153; C-140 to A-154; G-141 to A-155; L-142 to L-156; Q-143 to Q-157; E-144 to Y-158; L-145 to L-159; G-146 to Y-160; P-147 to L-161; G-148 to Q-162; L-149 to D-163; F-150 to N-164; R-151 to A-165; G-152 to L-166; L-153 to Q-167; A-154 to A-168; A-155 to L-169; L-156 to P-170; Q-157 to D-171; Y-158 to D-172; L-159 to T-173; Y-160 to F-174; L-161 to R-175; Q-162 to D-176; D-163 to L-177; N-164 to G-178; A-165 to N-179; L-166 to L-180; Q-167 to T-181; A-168 to H-182; L-169 to L-183; P-170 to F-184; D-171 to L-185; D-172 to H-186; T-173 to G-187; F-174 to N-188; R-175 to R-189; D-176 to 1-190; L-177 to 5-191; G-178 to 5-192; N-179 to V-193; L-180 to P-194; T-181 to E-195; H-182 to R-196; L-183 to A-197; F-184 to F-198; L-185 to R-199; H-186 to G-200; G-187 to L-201; N-188 to H-202; R-189 to 5-203; I-190 to L-204; 5-191 to D-205; 5-192 to R-206; V-193 to L-207; P-194 to L-208; E-195 to L-209; R-196 to H-210; A-197 to Q-211; F-198 to N-212; R-199 to R-213; G-200 to V-214; L-201 to A-215; H-202 to H-216; S-203 to V-217; L-204 to H-218; D-205 to P-219; R-206 to H-220; L-207 to A-221; L-208 to F-222; L-209 to R-223; H-210 to D-224; Q-211 to L-225; N-212 to G-226; R-213 to R-227; V-214 to L-228; A-215 to M-229; H-216 to T-230; V-217 to L-231; H-218 to Y-232; P-219 to L-233; H-220 to F-234; A-221 to A-235; F-222 to N-236; R-223 to N-237; D-224 to L-238; L-225 to S-239; G-226 to A-240; R-227 to L-241; L-228 to P-242; M-229 to T-243; T-230 to E-244; L-231 to A-245; Y-232 to L-246; L-233 to A-247; F-234 to P-248; A-235 to L-249; N-236 to R-250; N-237 to A-251; L-238 to L-252; S-239 to Q-253; A-240 to Y-254; L-241 to L-255; P-242 to R-256; T-243 to L-257; E-244 to N-258; A-245 to D-259; L-246 to N-260; A-247 to P-261; P-248 to W-262; L-249 to V-263; R-250 to C-264; A-251 to D-265; L-252 to C-266; Q-253 to R-267; Y-254 to A-268; L-255 to R-269; R-256 to P-270; L-257 to L-271; N-258 to W-272; D-259 to A-273; N-260 to W-274; P-261 to L-275; W-262 to Q-276; V-263 to K-277; C-264 to F-278; D-265 to R-279; C-266 to G-280; R-267 to S-281; A-268 to S-282; R-269 to S-283; P-270 to E-284; L-271 to V-285; W-272 to P-286; A-273 to C-287; W-274 to S-288; L-275 to L-289; Q-276 to P-290; K-277 to Q-291; F-278 to R-292; R-279 to L-293; G-280 to A-294; S-281 to G-295; S-282 to R-296; S-283 to D-297; E-284 to L-298; V-285 to K-299; P-286 to R-300; C-287 to L-301; S-288 to A-302; L-289 to A-303; P-290 to N-304; Q-291 to D-305; R-292 to L-306; L-293 to Q-307; A-294 to G-308; G-295 to C-309; R-296 to A-310; D-297 to V-311; L-298 to A-312; K-299 to T-313; R-300 to G-314; L-301 to P-315; A-302 to Y-316; A-303 to H-317; N-304 to P-318; D-305 to 1-319; L-306 to W-320; Q-307 to T-321; G-308 to G-322; C-309 to R-323; A-310 to A-324; V-311 to T-325; A-312 to D-326; T-313 to E-327; G-314 to E-328; P-315 to P-329; Y-316 to L-330; H-317 to G-331; P-318 to L-332; I-319 to P-333; W-320 to K-334; T-321 to C-335; G-322 to C-336; R-323 to Q-337; A-324 to P-338; T-325 to D-339; D-326 to A-340; E-327 to A-341; E-328 to D-342; P-329 to K-343; L-330 to A-344; G-331 to S-345; L-332 to V-346; P-333 to L-347; K-334 to E-348; C-335 to P-349; C-336 to G-350; Q-337 to R-351; P-338 to P-352; D-339 to A-353; A-340 to S-354; A-341 to A-355; D-342 to G-356; K-343 to N-357; A-344 to A-358; S-345 to L-359; V-346 to K-360; L-347 to G-361; E-348 to R-362; P-349 to V-363; G-350 to P-364; R-351 to P-365; P-352 to G-366; A-353 to D-367; S-354 to S-368; A-355 to P-369; G-356 to P-370; N-357 to G-371; A-358 to N-372; L-359 to G-373; K-360 to S-374; G-361 to G-375; R-362 to P-376; V-363 to R-377; P-364 to H-378; P-365 to 1-379; G-366 to N-380; D-367 to D-381; S-368 to S-382; P-369 to P-383; P-370 to F-384; G-371 to G-385; N-372 to T-386; G-373 to L-387; S-374 to P-388; G-375 to G-389; P-376 to S-390; R-377 to A-391; H-378 to E-392; I-379 to P-393; N-380 to P-394; D-381 to A-395; S-382 to H-396; P-383 to C-397; F-384 to S-398; G-385 to A-399; T-386 to A-400; L-387 to R-401; P-388 to G-402; G-389 to L-403; S-390 to R-404; A-391 to A-405; E-392 to T-406; P-393 to R-407; P-394 to F-408; A-395 to P-409; H-396 to T-410; C-397 to S-411; S-398 to G-412; A-399 to P-413; A-400 to R-414; R-401 to R-415; G-402 to R-416; L-403 to P-417; R-404 to G-418; A-405 to C-419; T-406 to S-420; R-407 to R-421; F-408 to K-422; P-409 to N-423; T-410 to R-424; S-411 to T-425; G-412 to R-426; P-413 to S-427; R-414 to H-428; R-415 to C-429; R-416 to R-430; P-417 to L-431; G-418 to G-432; C-419 to Q-433; S-420 to A-434; R-421 to G-435; K-422 to S-436; N-423 to G-437; R-424 to G-438; T-425 to G-439; R-426 to G-440; S-427 to T-441; H-428 to G-442; C-429 to D-443; R-430 to S-444; L-431 to E-445; G-432 to G-446; Q-433 to S-447; A-434 to G-448; G-435 to A-449; S-436 to L-450; G-437 to P-451; G-438 to S-452; G-439 to L-453; G-440 to T-454; T-441 to C-455; G-442 to S-456; D-443 to L-457; S-444 to T-458; E-445 to P-459; G-446 to L-460; S-447 to G-461; G-448 to L-462; A-449 to A-463; L-450 to L-464; P-451 to V-465; S-452 to L-466; L-453 to W-467; T-454 to T-468; C-455 to V-469; S-456 to L-470; L-457 to G-471; T-458 to P-472; and P-459 to C-473 of SEQ ID NO:163. Polynucleotides encoding these polypeptides are also encompassed by the invention. Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides, or the complement there of are encompassed by the invention. Antibodies that bind polypeptides of the invention are also encompassed by the invention. Polynucleotides encoding these polypeptides are also encompassed by the invention.

The present invention is also directed to proteins containing polypeptides at least 80%, 85%, 90%, 92%, 93%, 94%, 95%, 96%, 97%, 98% or 99% identical to a polypeptide sequence set forth herein as m-n. In preferred embodiments, the application is directed to proteins containing polypeptides at least 80%, 85%, 90%, 95%, 96%, 97%, 98% or 99% identical to polypeptides having the amino acid sequence of the specific N- and C-terminal deletions recited herein. Polynucleotides encoding these polypeptides are also encompassed by the invention.

Also included are polynucleotide sequences encoding a polypeptide consisting of a portion of the complete amino acid sequence encoded by a cDNA clone contained in ATCC Deposit No. 209782, where this portion excludes any integer of amino acid residues from 1 to about 467 amino acids from the amino terminus of the complete amino acid sequence encoded by a cDNA clone contained in ATCC Deposit No. 209782, or any integer of amino acid residues from 6 to about 473 amino acids from the carboxy terminus, or any combination of the above amino terminal and carboxy terminal deletions, of the complete amino acid sequence encoded by the cDNA clone contained in ATCC Deposit No. 209782. Polypeptides encoded by these polynucleotides also are encompassed by the invention. Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides, or the complement there of are encompassed by the invention. Antibodies that bind polypeptides of the invention are also encompassed by the invention. Polynucleotides encoding these polypeptides are also encompassed by the invention.

The translation product of this gene shares sequence homology with ALS (Acid Labile Subunit of Insulin-Like Growth Factor) which is thought to be important in the regulation of IGF availability. As such, it is likely that the product of this gene is involved in the regulation of various proliferation-dependent cellular processes that may be attributable to cancer progression (See Genbank Accession No. gi|184808; all references available through this accession are hereby incorporated by reference herein).

The gene encoding the disclosed cDNA is believed to reside on chromosome 22. Accordingly, polynucleotides related to this invention are useful as a marker in linkage analysis for chromosome 22.

As described herein or otherwise known in the art, the polynucleotides of the invention have uses that include, but are not limited to, serving as probes or primers in chromosome identification, chromosome mapping, and linkage analysis.

Polynucleotides and polypeptides of the invention are useful as reagents for differential identification of the tissue(s) or cell type(s) present in a biological sample and for diagnosis of diseases and conditions which include, but are not limited to, neurodegenerative diseases, growth deficiencies, osteoporosis, catabolic disorders, diabetes, ovarian cancer, neuronal injury spinal injury, post-spinal trauma neurite outgrowth, inflammation, and neuronal injury, and disorders of the central and peripheral nervous system. Similarly, polypeptides and antibodies directed to these polypeptides are useful in providing immunological probes for differential identification of the tissue(s) or cell type(s). For a number of disorders of the above tissues or cells, particularly of the nervous system and other peripheral tissues, expression of this gene at significantly higher or lower levels may be routinely detected in certain tissues or cell types (e.g., neural, neuronal, proliferating, and/or other tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution cerebellum and homology to ALS (Acid Labile Subunit of Insulin-Like Growth Factor) indicates that polynucleotides and polypeptides corresponding to this gene are useful for the treatment and diagnosis of a variety of metabolic disorders, growth deficiencies, osteoporosis, catabolic disorders (including AIDS) and diabetes. Nearly all of the insulin-like growth factor (IGF) in the circulation is bound in a heterotrimeric complex composed of IGF, IGF-binding protein-3, and the acid-labile subunit (ALS). The protein product of this gene therefore may afford the ability to potentiate the biological actions of IGF or similar growth factors and cytokines. Studies which demonstrate the beneficial effect of IGF-I in amyotrophic lateral-sclerosis, would suggest a role in this disease as well. Alternatively, the tissue distribution in cancerous ovarian tissue indicates polynucleotides and polypeptides corresponding to this gene are useful for the treatment, diagnosis, and/or prevention of various skin disorders. Furthermore, the protein may also be used to determine biological activity, raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Polynucleotides or polypeptides of the invention and/or agonists and/or antagonists thereof, are used to treat, prevent, and/or diagnose diseases and disorders of the nervous system.

In specific embodiments, the polynucleotides and/or polypeptides corresponding to this gene and/or agonists or antagonists of those polypeptides (including antibodies) as well as fragments and variants of those polynucleotides, polypeptides agonists and antagonists, may be used to diagnose, prognose or monitor neurological diseases, neural injury, and/or spinal cord injury. In other specific embodiments, the polynucleotides and/or polypeptides corresponding to this gene and/or agonists or antagonists of those polypeptides (including antibodies) as well as fragments and variants of those polynucleotides, polypeptides agonists and antagonists, may be used to treat, prevent, or ameliorate neurological disease, neural injury, and/or spinal cord injury.

In other preferred embodiments, the polynucleotides and/or polypeptides corresponding to this gene and/or agonists or antagonists of those polypeptides (including antibodies) as well as fragments and variants of those polynucleotides, polypeptides agonists and antagonists, may be used to diagnose, prognose or monitor diseases and disorders associated with aberrant neurite outgrowth.

By "agonist," is meant any substance that enhances the function of the polynucleotides or polypeptides of the invention. Classes of molecules that can function as agonists include, but are not limited to, small molecules, antibodies (including fragments or variants thereof, such as Fab fragments, Fab'2 fragments and scFvs), and peptidomimetics. By "antagonist," is meant any substance that diminishes or abolishes the function of the polynucleotides or polypeptides of the invention. Classes of molecules that can function as antagonists include, but are not limited to, small molecules, antibodies (including fragments or variants thereof, such as Fab fragments, Fab'2 fragments and scFvs) antisense polynucleotides, ribozymes, and peptidomimetics.

In another embodiment, the polynucleotides and/or polypeptides corresponding to this gene and/or antagonists thereof (especially neutralizing or antagonistic antibodies) may be used to treat, prevent, and/or ameliorate neurological disease, neural injury, and/or spinal cord injury. Additionally, in other embodiments, the polynucleotides and/or polypeptides corresponding to this gene and/or anatgonists thereof (especially neutralizing or antagonistic antibodies) may be used to treat, prevent, or ameliorate conditions associated with ameliorate neurological disease, neural injury, and/or spinal cord injury, including, but not limited to, Alzheimer's disease, Parkinson's disease, Huntington's disease, amylotrophic lateral sclerosis and the like, as well as spinocerebellar degenerations, and other neurological diseases and disorders as described in the "Neural Activity and Neurological Activity diseases" section below, In a preferred embodiment, the polynucleotides and/or polypeptides corresponding to this gene and/or antagonists thereof (especially neutralizing or antagonistic antibodies) may be used to treat, prevent, and/or ameliorate neural injury, and/or spinal cord injury following spinal cord and neural trauma. For example, neural outgrowth and inflammation. Additionally, in other embodiments, the polynucleotides and/ or polypeptides corresponding to this gene and/or anatgonists thereof (especially neutralizing or antagonistic antibodies) may be used to treat, prevent, or ameliorate conditions associated with ameliorate neurological disease, neural injury, and/or spinal cord injury, including, but not limited to, Alzheimer's disease, Parkinson's disease, Huntington's disease, amylotrophic lateral sclerosis and the like, as well as spinocerebellar degenerations, and other neurolgical diseases and disorders as described in the "Neural Activity and Neurological Activity diseases" section below In another embodiment, compositions of the invention i.e., Therapeutics (comprising polynucleotides, polypeptides of the invention, agonists and/or antagonists thereof (including antibodies) as well as fragments and variants of the polynucleotides, polypeptides of the invention, agonists and/or antagonists of the invention) are used in combination with antiinflammatory drugs (e.g., as described herein) and/or drugs used to treat spinal cord injury, neural injury, or neurological disease.

In certain embodiments, the Therapeutics of the invention are administered in combination with agents used to treat psychiatric disorders. Psychiatric drugs that may be administered with the Therapeutics of the invention include, but are not limited to, antipsychotic agents (e.g., chlorpromazine, chlorprothixene, clozapine, fluphenazine, haloperidol, loxapine, mesoridazine, molindone, olanzapine, perphenazine, pimozide, quetiapine, risperidone, thioridazine, thiothixene, trifluoperazine, and triflupromazine), antimanic agents (e.g., carbamazepine, divalproex sodium, lithium carbonate, and lithium citrate), antidepressants (e.g., amitriptyline, amoxapine, bupropion, citalopram, clomipramine, desipramine, doxepin, fluvoxamine, fluoxetine, imipramine, isocarboxazid, maprotiline, mirtazapine, nefazodone, nortriptyline, paroxetine, phenelzine, protriptyline, sertraline, tranylcypromine, trazodone, trimipramine, and venlafaxine), antianxiety agents (e.g., alprazolam, buspirone, chlordiazepoxide, clorazepate, diazepam, halazepam, lorazepam, oxazepam, and prazepam), and stimulants (e.g., d-amphetamine, methylphenidate, and pemoline).

In other embodiments, the Therapeutics of the invention are administered in combination with agents used to treat neurological disorders. Neurological agents that may be administered with the Therapeutics of the invention include, but are not limited to, antiepileptic agents (e.g., carbamazepine, clonazepam, ethosuximide, phenobarbital, phenyloin, primidone, valproic acid, divalproex sodium, felbamate, gabapentin, lamotrigine, levetiracetam, oxcarbazepine, tiagabine, topiramate, zonisamide, diazepam, lorazepam, and clonazepam), antiparkinsonian agents (e.g., levodopa/carbidopa, selegiline, amantidine, bromocriptine, pergolide, ropinirole, pramipexole, benztropine; biperiden; ethopropazine; procyclidine; trihexyphenidyl, tolcapone), and ALS therapeutics (e.g. riluzole).

The polynucleotides, polypeptides and agonists or antagonists of the invention may also be used for the diagnosis and/or treatment of diseases, disorders, damage or injury of the brain and/or nervous system. Nervous system disorders that can be treated with the compositions of the invention (e.g., polypeptides, polynucleotides, and/or agonists or antagonists), include, but are not limited to, nervous system injuries, and diseases or disorders which result in either a disconnection of axons, a diminution or degeneration of neurons, or demyelination. Nervous system lesions which may be treated in a patient (including human and non-human mammalian patients) according to the methods of the invention, include but are not limited to, the following lesions of either the central (including spinal cord, brain) or peripheral nervous systems: (1) ischemic lesions, in which a lack of oxygen in a portion of the nervous system results in neuronal injury or death, including cerebral infarction or ischemia, or spinal cord infarction or ischemia; (2) traumatic lesions, including lesions caused by physical injury or associated with surgery, for example, lesions which sever a portion of the nervous system, or compression injuries; (3) malignant lesions, in which a portion of the nervous system is destroyed or injured by malignant tissue which is either a nervous system associated malignancy or a malignancy derived from non-nervous system tissue; (4) infectious lesions, in which a portion of the nervous system is destroyed or injured as a result of infection, for example, by an abscess or associated with infection by human immunodeficiency virus, herpes zoster, or herpes simplex virus or with Lyme disease, tuberculosis, or syphilis; (5) degenerative lesions, in which a portion of the nervous system is destroyed or injured as a result of a degenerative process including but not limited to, degeneration associated with Parkinson's disease, Alzheimer's disease, Huntington's chorea, or amyotrophic lateral sclerosis (ALS); (6) lesions associated with nutritional diseases or disorders, in which a portion of the nervous system is destroyed or injured by a nutritional disorder or disorder of metabolism including, but not limited to, vitamin B12 deficiency, folic acid deficiency, Wernicke disease, tobacco-alcohol amblyopia, Marchiafava-Bignami disease (primary degeneration of the corpus callosum), and alcoholic cerebellar degeneration; (7) neurological lesions associated with systemic diseases including, but not limited to, diabetes (diabetic neuropathy, Bell's palsy), systemic lupus erythematosus, carcinoma, or sarcoidosis; (8) lesions caused by toxic substances including alcohol, lead, or particular neurotoxins; and (9) demyelinated lesions in which a portion of the nervous system is destroyed or injured by a demyelinating disease including, but not limited to, multiple sclerosis, human immunodeficiency virus-associated myelopathy, transverse myelopathy or various etiologies, progressive multifocal leukoencephalopathy, and central pontine myelinolysis.

Additional neurologic diseases which can be treated or detected with polynucleotides, polypeptides, agonists, and/or antagonists of the present invention include nerve compression syndromes such as carpal tunnel syndrome, tarsal tunnel syndrome, thoracic outlet syndrome such as cervical rib syndrome, ulnar nerve compression syndrome, neuralgia such as causalgia, cervico-brachial neuralgia, facial neuralgia and trigeminal neuralgia, neuritis such as experimental allergic neuritis, optic neuritis, polyneuritis, polyradiculoneuritis and radiculities such as polyradiculitis, hereditary motor and sensory neuropathies such as Charcot-Marie Disease, Hereditary Optic Atrophy, Refsum's Disease, Hereditary Spastic Paraplegia and Werdnig-Hoffmann Disease, Hereditary Sensory and Autonomic Neuropathies which include Congenital Analgesia and Familial Dysautonomia, POEMS Syndrome, Sciatica, Gustatory Sweating and Tetany).

Additional diseases which can be treated or detected with polynucleotides, polypeptides, agonists, and/or antagonists of the present invention include, but are not limited to neoplastic disease of the CNS e.g. glioma, glioblastoma, medulloblastoma, craniopharyngioma, ependyoma, pinealoma, haemangioblastoma, acoustic neuroma, oligodendroglioma, menagioma, neuroblastoma or retinoblastoma and degenerative nerve diseases e.g. Alzheimer's and Parkinson's diseases. Representative uses are described in the "Regeneration" and "Hyperproliferative Disorders" sections below, in Example 11, 15, 39, 41, 42, 43, and 51, and elsewhere herein. Therapeutics can be used to treat or prevent hyperproliferative or benign dysproliferative disorders e.g. psoriasis and tissue hypertrophy. Ribozymes or antisense nucleic acids can be used to inhibit production of the polypeptides of the invention, to induce regeneration of neurons or to promote structural plasticity of the CNS in disorders where neurite growth, regeneration or maintenance are deficient or desired. The animal models can be used in diagnostic and screening methods for predisposition to disorders and to screen for or test molecules which can treat or prevent disorders or diseases of the CNS.

Furthermore, the protein may also be used to determine biological activity, raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 31

The translation product of this gene was shown to have homology to diacylglycerol kinase which is known to be important in lipid metabolism (See Genebank Accession No.gi|1939; all references available through this accession are hereby incorporated by reference herein).

Preferred polypeptides of the invention comprise, or alternatively consist of, an amino acid sequence selected from the group: MVVADRNRASSSSYLCLLLFSLSLFLCHETVCDRATCLFFFLKFFFLFMCRCMSWGFKNFKAGLLMQSMPTSGILRERKRLHVVRIPQGTEKKLETVEMQI (SEQ ID NO: 355), and/or IPQGTEKKL ETV (SEQ ID NO: 356). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

This gene is expressed in brain.

Polynucleotides and polypeptides of the invention are useful as reagents for differential identification of the tissue(s) or cell type(s) present in a biological sample and for diagnosis of diseases and conditions which include, but are not limited to, developmental and neurodegenerative diseases of the brain and nervous system. Similarly, polypeptides and antibodies directed to these polypeptides are useful in providing immunological probes for differential identification of the tissue(s) or cell type(s). For a number of disorders of the above tissues or cells, particularly of the brain, expression of this gene at significantly higher or lower levels may be routinely detected in certain tissues or cell types (e.g., neural, and/or other tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 164 as residues: Gly-49 to Ser-54, Lys-61 to Arg-68. Polynucleotides encoding said polypeptides are also encompassed by the invention.

The tissue distribution in brain combined with the homology to a known enzyme involved in lipid metabolism indicates that polynucleotides and polypeptides corresponding to this gene are useful for the detection, treatment, and/or prevention of neurodegenerative disease states, behavioral disorders, or inflammatory conditions. Representative uses are described in the "Regeneration" and "Hyperproliferative Disorders" sections below, in Example 11, 15, 39, 41, 42, 43, and 51, and elsewhere herein. Briefly, the uses include, but are not limited to the detection, treatment, and/or prevention of Alzheimer's Disease, Parkinson's Disease, Huntington's Disease, Tourette Syndrome, meningitis, encephalitis, demyelinating diseases, peripheral neuropathies, neoplasia, trauma, congenital malformations, spinal cord injuries, ischemia and infarction, aneurysms, hemorrhages, schizophrenia, mania, dementia, paranoia, obsessive compulsive disorder, depression, panic disorder, learning disabilities, ALS, psychoses, autism, and altered behaviors, including disorders in feeding, sleep patterns, balance, and perception. In particular, this gene may have utility in the diagnosis, treatment, and/or prevention of disorders involving the PNS, CNS and/or other tissues which rely on lipid-containing structures such as myelin sheath dependent nerves.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 32

This gene is expressed in amygdala and testes.

Polynucleotides and polypeptides of the invention are useful as reagents for differential identification of the tissue(s) or cell type(s) present in a biological sample and for diagnosis of diseases and conditions which include, but are not limited to, testicular disorders, and developmental and neurodegenerative diseases of the brain and nervous system. Similarly, polypeptides and antibodies directed to these polypeptides are useful in providing immunological probes for differential identification of the tissue(s) or cell type(s). For a number of disorders of the above tissues or cells, particularly of the brain, expression of this gene at significantly higher or lower levels may be routinely detected in certain tissues or cell types (e.g., cancerous and wounded tissues) or bodily fluids (e.g., lymph, serum, plasma, urine, synovial fluid and spinal fluid)

or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 165 as residues: Met-1 to Lys-6. Polynucleotides encoding said polypeptides are also encompassed by the invention.

The tissue distribution in amygdala indicates that polynucleotides and polypeptides corresponding to this gene are useful for the detection, treatment, and/or prevention of neurodegenerative disease states, behavioral disorders, or inflammatory conditions. Representative uses are described in the "Regeneration" and "Hyperproliferative Disorders" sections below, in Example 11, 15, 39, 41, 42, 43, and 51, and elsewhere herein. Briefly, the uses include, but are not limited to the detection, treatment, and/or prevention of aphasia, depression, schizophrenia, Alzheimer's disease, Parkinson's disease, Huntington's disease, specific brain tumors, mania, dementia, paranoia, addictive behavior and sleep disorders. The amygdala processes sensory information and relays this to other areas of the brain including the endocrine and autonomic domains of the hypothalamus and the brain stem. As such, the translation product of this gene may show commercial utility in the diagnosis, treatment, and/or prevention of various endocrine, cardiovascular, and pulmonary disorders, particularly those disorders directly associated with CNS/autonomic control.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 33

The gene encoding the disclosed cDNA is believed to reside on chromosome 9. Accordingly, polynucleotides related to this invention are useful as a marker in linkage analysis for chromosome 9.

In specific embodiments, polypeptides of the invention comprise, or alternatively consist of, the following amino acid sequence: NPRLPLPRGGS LRLLSSPANSNNAKAY-PFSRFPSPIF (SEQ ID NO: 357). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding this polypeptide are encompassed by the invention. Antibodies that bind polypeptides of the invention are also encompassed by the invention. Polynucleotides encoding said polypeptides are also encompassed by the invention.

This gene is expressed in B-cell lymphoma.

Polynucleotides and polypeptides of the invention are useful as reagents for differential identification of the tissue(s) or cell type(s) present in a biological sample and for diagnosis of diseases and conditions which include, but are not limited to, haemopoietic and immune diseases and/or disorders including cancer. Similarly, polypeptides and antibodies directed to these polypeptides are useful in providing immunological probes for differential identification of the tissue(s) or cell type(s). For a number of disorders of the above tissues or cells, particularly of the haemopoietic and immune system, expression of this gene at significantly higher or lower levels may be routinely detected in certain tissues or cell types (e.g., immune, hematopoietic, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in B-cell lymphoma indicates polynucleotides and polypeptides corresponding to this gene are useful for the treatment and diagnosis of hematopoietic related disorders such as anemia, pancytopenia, leukopenia, thrombocytopenia or leukemia since stromal cells are important in the production of cells of hematopoietic lineages. Representative uses are described in the "Immune Activity" and "Infectious Disease" sections below, in Example 11, 13, 14, 16, 18, 19, 20, 32, 33, 34, 53, and 58, and elsewhere herein. Briefly, the uses include bone marrow cell ex-vivo culture, bone marrow transplantation, bone marrow reconstitution, radiotherapy or chemotherapy of neoplasia.

The gene product may also be involved in lymphopoiesis, therefore, it can be used in immune disorders such as infection, inflammation, allergy, immunodeficiency etc. In addition, this gene product may have commercial utility in the expansion of stem cells and committed progenitors of various blood lineages, and in the differentiation and/or proliferation of various cell types. Therefore it is also useful as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersensitivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus erythematosis, drug induced hemolytic anemia, rheumatoid arthritis, Sjogren's disease, and scleroderma.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 34

This gene is expressed in breast cancer.

Polynucleotides and polypeptides of the invention are useful as reagents for differential identification of the tissue(s) or cell type(s) present in a biological sample and for diagnosis of diseases and conditions which include, but are not limited to, diseases and/or disorders of the reproductive organs and cancer, particularly of the mammary glands Similarly, polypeptides and antibodies directed to these polypeptides are useful in providing immunological probes for differential identification of the tissue(s) or cell type(s). For a number of disorders of the above tissues or cells, particularly of the reproductive system, expression of this gene at significantly higher or lower levels may be routinely detected in certain tissues or cell types (e.g., reproductive, breast, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 167 as residues: Asp-77 to Gly-127. Polynucleotides encoding said polypeptides are also encompassed by the invention.

The tissue distribution in tumors of breast origins indicates that polynucleotides and polypeptides corresponding to this gene are useful for diagnosis and intervention of such tumors, in addition to other tumors. Representative uses are described in the "Hyperproliferative Disorders", "Infectious Disease", and "Binding Activity" sections below, in Example 11, and 51, and elsewhere herein.

Furthermore, the protein may also be used to determine biological activity, raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 35

Preferred polypeptides encoded by this gene comprise, or alternatively consist of, an amino acid sequence selected from the group: MVQEAPALVRLS LGSHRVKGPLPV-LKLQPEGWSPSTLWSCASVWKDSC (SEQ ID NO: 358), and/or ALASSLVAENQGFVAALMVQEAPALVRLSLG-SHRVKGPLPVLKLQPEGWSPSTLWSCASVWKDSC MHPWRLSMCPACVLAALPALCSCLCSP-DARPPHGWMSMPFTPHPLVSRAMPTCHPCS (SEQ ID NO: 359). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridize, under stringent conditions, to the polynucleotide encoding this polypeptide are encompassed by the invention. Antibodies that bind polypeptides of the invention are also encompassed by the invention. Polynucleotides encoding said polypeptides are also encompassed by the invention.

The gene encoding the disclosed cDNA is believed to reside on chromosome 11. Accordingly, polynucleotides related to this invention are useful as a marker in linkage analysis for chromosome 11.

This gene is expressed in placenta, dendritic cells, brain, and to a lesser extent in infant cells and tissues.

Polynucleotides and polypeptides of the invention are useful as reagents for differential identification of the tissue(s) or cell type(s) present in a biological sample and for diagnosis of diseases and conditions which include, but are not limited to, diseases and/or disorders of developing cells and tissues, particularly growth disorders. Similarly, polypeptides and antibodies directed to these polypeptides are useful in providing immunological probes for differential identification of the tissue(s) or cell type(s). For a number of disorders of the above tissues or cells, particularly of the placenta and other developing organs and tissues, expression of this gene at significantly higher or lower levels may be routinely detected in certain tissues or cell types (e.g., developing, neural, placental, brain, and cancerous and wounded tissues) or bodily fluids (e.g., lymph, serum, amniotic fluid, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 168 as residues: Pro-27 to Gly-34. Polynucleotides encoding said polypeptides are also encompassed by the invention.

The tissue distribution in placental tissue indicates the protein is useful in the detection, treatment, and/or prevention of vascular conditions, which include, but are not limited to, microvascular disease, vascular leak syndrome, aneurysm, stroke, atherosclerosis, arteriosclerosis, or embolism. For example, this gene product may represent a soluble factor produced by smooth muscle that regulates the innervation of organs or regulates the survival of neighboring neurons. Likewise, it is involved in controlling the digestive process, and such actions as peristalsis. Similarly, it is involved in controlling the vasculature in areas where smooth muscle surrounds the endothelium of blood vessels.

The expression within cellular sources marked by proliferating cells (e.g., infant cells and tissues) indicates this protein may play a role in the regulation of cellular division, and may show utility in the diagnosis, treatment, and/or prevention of developmental diseases and disorders, cancer, and other proliferative conditions. Representative uses are described in the "Hyperproliferative Disorders" and "Regeneration" sections below and elsewhere herein. Briefly, developmental tissues rely on decisions involving cell differentiation and/or apoptosis in pattern formation. Dysregulation of apoptosis can result in inappropriate suppression of cell death, as occurs in the development of some cancers, or in failure to control the extent of cell death, as is believed to occur in acquired immunodeficiency and certain neurodegenerative disorders, such as spinal muscular atrophy (SMA). Because of potential roles in proliferation and differentiation, this gene product may have applications in the adult for tissue regeneration and the treatment of cancers. It may also act as a morphogen to control cell and tissue type specification. Therefore, the polynucleotides and polypeptides of the present invention are useful in treating, detecting, and/or preventing said disorders and conditions, in addition to other types of degenerative conditions. Thus this protein may modulate apoptosis or tissue differentiation and is useful in the detection, treatment, and/or prevention of degenerative or proliferative conditions and diseases. The protein is useful in modulating the immune response to aberrant polypeptides, as may exist in proliferating and cancerous cells and tissues. The protein can also be used to gain new insight into the regulation of cellular growth and proliferation.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 36

The translation product of this gene shares sequence homology with ion channel proteins which are thought to be important in many physiological processes including neural and muscular function (See, for example, Genebank Accession No. gid 1065507, and gb|AAC68885.1; all references available through these accession numbers are hereby incorporated herein; for example, FEBS Lett. 445, 231-236 (1999)). Specifically, this protein is homologous to the putative four repeat ion channel of *Rattus norvegicus*. Based upon the sequence similarity, the translation product of this gene is expected to share at least some biological activities with ion channel proteins. Such activities are known in the art, some of which are described elsewhere herein.

Preferred polypeptides comprise, or alternatively consist of, an amino acid selected from the group:

FYFITLIFFLAWLVKNVFIAVIIETFAEIRVQF (SEQ ID NO: 360), SIFTVYEAASQEGWV (SEQ ID NO: 361), and/or HEGTSIFT VYEAASQEGWVFL (SEQ ID NO: 362). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

This gene is expressed in spinal cord.

Polynucleotides and polypeptides of the invention are useful as reagents for differential identification of the tissue(s) or cell type(s) present in a biological sample and for diagnosis of diseases and conditions which include, but are not limited to, diseases of the central and peripheral nervous system, particularly neural degenerative conditions, and is useful in restoring cognitive function. Similarly, polypeptides and antibodies directed to these polypeptides are useful in providing immunological probes for differential identification of the tissue(s) or cell type(s). For a number of disorders of the above tissues or cells, particularly of the neural system, expression of this gene at significantly higher or lower levels may be routinely detected in certain tissues or cell types (e.g., neural, brain, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 169 as residues: Phe-8 to Ser-13, Ala-84 to Ser-90. Polynucleotides encoding said polypeptides are also encompassed by the invention.

The tissue distribution in spinal cord tissue, combined with the homology to ion channel proteins, indicates polynucleotides and polypeptides corresponding to this gene are useful for the detection, treatment, and/or prevention of neurodegenerative disease states, behavioral disorders, or inflammatory conditions. Representative uses are described in the "Regeneration" and "Hyperproliferative Disorders" sections below, in Example 11, 15, 39, 41, 42, 43, and 51, and elsewhere herein. Briefly, the uses include, but are not limited to the detection, treatment, and/or prevention of Alzheimer's Disease, Parkinson's Disease, Huntington's Disease, Tourette Syndrome, meningitis, encephalitis, demyelinating diseases, peripheral neuropathies, neoplasia, trauma, congenital malformations, spinal cord injuries, ischemia and infarction, aneurysms, hemorrhages, schizophrenia, mania, dementia, paranoia, obsessive compulsive disorder, depression, panic disorder, learning disabilities, ALS, psychoses, autism, and altered behaviors, including disorders in feeding, sleep patterns, balance, and perception. In addition, elevated expression of this gene product in regions of the brain indicates it plays a role in normal neural function. Potentially, this gene product is involved in synapse formation, neurotransmission, learning, cognition, homeostasis, or neuronal differentiation or survival.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 37

When tested against fibroblast cell lines, supernatants removed from cells containing this gene activated the early growth response gene 1 (EGR) pathway. Thus, it is likely that this gene activates fibroblast cells, and to a lesser extent, other cells and tissue cell-types, through the EGR signal transduction pathway. The early growth response gene is a separate signal transduction pathway from the Jaks-STAT, genes containing the EGR1 promoter are induced in various tissues and cell types upon activation, leading the cells to undergo differentiation and proliferation.

The polypeptide of this gene has been determined to have a transmembrane domain at about amino acid position 13-29 of the amino acid sequence referenced in Table 1A for this gene. Moreover, a cytoplasmic tail encompassing amino acids 30-59 of this protein has also been determined. Based upon these characteristics, it is believed that the protein product of this gene shares structural features to type Ib membrane proteins.

Additionally, portions of the translation product of this gene shares sequence homology with TM5 consensus sequences (see, e.g., Genseq accession number R50725; all references available through this accession are hereby incorporated by reference herein.). Based on the sequence similarity, the translation product of this gene is expected to share at least some biological activities with TM5 proteins. Such activities are known in the art, some of which are described elsewhere herein.

This gene is expressed in uterus, colon cancer, synovium, fetal lung, and to a lesser extent in fetal and adult heart.

Polynucleotides and polypeptides of the invention are useful as reagents for differential identification of the tissue(s) or cell type(s) present in a biological sample and for diagnosis of diseases and conditions which include, but are not limited to, diseases and/or disorders of developing cells and tissues, particularly infertility and cancer. Similarly, polypeptides and antibodies directed to these polypeptides are useful in providing immunological probes for differential identification of the tissue(s) or cell type(s). For a number of disorders of the above tissues or cells, particularly of the developing and reproductive systems, expression of this gene at significantly higher or lower levels may be routinely detected in certain tissues or cell types (e.g., reproductive, developing, gastrointestinal, synovium, skeletal, heart, lung, cardiovascular, and cancerous and wounded tissues) or bodily fluids (e.g., lymph, serum, amniotic fluid, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 170 as residues: Lys-32 to His-38. Polynucleotides encoding said polypeptides are also encompassed by the invention.

The tissue distribution in developing and reproductive tissues, combined with the detected EGR1 biological activity, indicates this protein may play a role in the regulation of cellular division, and may show utility in the diagnosis, treatment, and/or prevention of developmental diseases and disorders, including cancer, and other proliferative conditions. Representative uses are described in the "Hyperproliferative Disorders" and "Regeneration" sections below and elsewhere herein. Briefly, developmental tissues rely on decisions involving cell differentiation and/or apoptosis in pattern formation. Dysregulation of apoptosis can result in inappropriate suppression of cell death, as occurs in the development of some cancers, or in failure to control the extent of cell death, as is believed to occur in acquired immunodeficiency and certain neurodegenerative disorders, such as spinal muscular atrophy (SMA).

Because of potential roles in proliferation and differentiation, this gene product may have applications in the adult for tissue regeneration and the treatment of cancers. It may also act as a morphogen to control cell and tissue type specification. Therefore, the polynucleotides and polypeptides of the present invention are useful in treating, detecting, and/or preventing said disorders and conditions, in addition to certain types of degenerative conditions. Thus this protein may modulate apoptosis or tissue differentiation and is useful in the detection, treatment, and/or prevention of degenerative or proliferative conditions and diseases. The protein is useful in modulating the immune response to aberrant polypeptides, as may exist in proliferating and cancerous cells and tissues. The protein can also be used to gain new insight into the regulation of cellular growth and proliferation.

The tissue distribution combined with the detected EGR1 biological activity and homology to TM5 consensus regions indicates this protein likely plays a role in signal transduction and/or the regulation thereof, and may show utility in the diagnosis, treatment, and/or prevention of disorders in which the normal physiological signal transduction pathway in disregulated.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 38

Preferred polypeptides of the invention comprise, or alternatively consist of, the following amino acid sequence: CKTSFGLA (SEQ ID NO: 363). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

In an alternative embodiment, polypeptides of the invention comprise, or alternatively consist of, the following amino acid sequence: MITLSSAFSAKQKTHAHKNTHACM-CATDMANPKLVLHFEVIVALLSLL QTILSLLLGQRTWLAHLYVLSTENX-ALHTVGTQKHLLPHDWCFGKH-CVSCRHHIFHRFCSIFSSTLKRSQGF E G (SEQ ID NO: 364). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

This gene is expressed in fetal bone, B and T cell lymphoma, and dendritic cells.

Polynucleotides and polypeptides of the invention are useful as reagents for differential identification of the tissue(s) or cell type(s) present in a biological sample and for diagnosis of diseases and conditions which include, but are not limited to, hematopoietic, skeletal, and immune diseases and/or disorders. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., immune, hematopoietic, skeletal, developmental, and cancerous and wounded tissues) or bodily fluids (e.g., lymph, serum, plasma, amniotic fluid, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 171 as residues: Ser-33 to His-42. Polynucleotides encoding said polypeptides are also encompassed by the invention.

The tissue distribution in T-cells and dendritic cells indicates polynucleotides and polypeptides corresponding to this gene are useful for the treatment and diagnosis of hematopoietic related disorders such as anemia, pancytopenia, leukopenia, thrombocytopenia or leukemia since stromal cells are important in the production of cells of hematopoietic lineages. Representative uses are described in the "Immune Activity" and "Infectious Disease" sections below, in Example 11, 13, 14, 16, 18, 19, 20, 32, 33, 34, 53, and 58, and elsewhere herein. Briefly, the uses include bone marrow cell ex-vivo culture, bone marrow transplantation, bone marrow reconstitution, radiotherapy or chemotherapy of neoplasia.

The gene product may also be involved in lymphopoiesis, therefore, it can be used in immune disorders such as infection, inflammation, allergy, immunodeficiency etc. In addition, this gene product may have commercial utility in the expansion of stem cells and committed progenitors of various blood lineages, and in the differentiation and/or proliferation of various cell types.

Moreover, the protein may represent a secreted factor that influences the differentiation or behavior of other blood cells, or that recruits hematopoietic cells to sites of injury.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 39

This gene is expressed in prostate.

Polynucleotides and polypeptides of the invention are useful as reagents for differential identification of the tissue(s) or cell type(s) present in a biological sample and for diagnosis of diseases and conditions which include, but are not limited to, reproductive diseases and/or disorders, particularly prostate cancer. Similarly, polypeptides and antibodies directed to these polypeptides are useful in providing immunological probes for differential identification of the tissue(s) or cell type(s). For a number of disorders of the above tissues or cells, particularly of the male reproductive system, expression of this gene at significantly higher or lower levels may be routinely detected in certain tissues or cell types (e.g., reproductive, prostate, and cancerous and wounded tissues) or bodily fluids (e.g., lymph, serum, plasma, urine, seminal fluid, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 172 as residues: Pro-21 to Pro-26, Arg-31 to Asn-37. Polynucleotides encoding said polypeptides are also encompassed by the invention.

The tissue distribution in prostate tissue indicates that the protein products of this gene are useful for the diagnosis and intervention of prostate cancers, in addition to other tumors within the urogenital and reproductive system. Therefore, this gene product is useful in the treatment of male infertility and/or impotence. This gene product is also useful in assays designed to identify binding agents, as such agents (antagonists) are useful as male contraceptive agents.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 40

The translation product of this gene shares sequence homology with the human proliferating-cell nucleolar antigen as well as to a protein from *Schizosaccharomyces pombe* of unknown function (See Genebank Accession Nos. 189422 and gn1|PID|e349594, as well as Medline Article 90315275; all references available through these accessions are hereby incorporated herein by reference). This protein is the most cancer specific of the proliferation-associated nucleolar proteins identified thus far. In addition, it is of special interest because of its expression pattern in the early G1 phase, and, in studies prior to 1989, it has not been detected in benign tumors and most normal resting tissues.

In another embodiment, polypeptides of the invention comprise, or alternatively consist of, an amino acid sequence selected from the group: SATEHGAVCCSCRRVGRRGEP-PGSIKGLVYSSNFQNVKQLYAL VCETQRYSAVLDAVI-ASAGLLRAEKKLRPHLAKVLVYELLLGKGFRGGGG-RWKALLGRHQARLKAE LARLKVHRGVS-RNEDLLEVGSRPGPASQLPRFVRVNTLK-TCSDDVVDYFKRQGFSYQGRASSLDDLRALK GKH-FLLDPLMPELLVFPAQTDLHEHPLYRAGHLILQDRAS-CLPAMLLDPPPGSHVID-ACAAPGNKTSHLAA LLKN-QGKIFAFDLDAKRLASMATLLAXAGVSCCELAEED-FLAVSPXDPRYXEVHYXLLDPSCSGSGMPSRQ LEXP-GAGTPSP- VRLHALAGFQQRALCHALTFPSLQR-LVYSTCSL- CQEENEDVVRDALQQNPGAFRLAPALP AWPHRGLSTFPGAEHCLRASPETTLSSGFFVAVIE-RVEXPSSASQAKASAPERTPSPAPKRKKRQQRA-AAGA CTPPCT (SEQ ID NO: 369), CAAPGNKTSHLAA (SEQ ID NO: 365), EHPLYRAGHLILQDRASCLPAMLL (SEQ ID NO: 366), LLDPSCSGSGMPSRQ (SEQ ID NO: 367), YSTCSLCQEENEDVVRDALQQNP (SEQ ID NO: 368), and/or YEPHSTHSRERAMTSHARVSLGPSRD-PLERPHLAK- VLVYELLLGKGFRGGGGRWKALLG RHQARLKAELARLKVHRGVSRNEDLLEVGSRPGP-ASQLPRFVRVNTLKTCSDDVVDYFKRQGFSYQGRAS SLDDLRALKGKHFLLDPLMPELLVFPAQTDLHEHP-LYRAGHLILQDRASCLPAMLLDPPPGSHVIDACAAP GNKTSHLAALLKNQGKIFAFDLDAKRLASMA-TLLAXAGVSCCELAEEDFLAVSPXDPRYXEVHY-XLLDPS CSGSGMPSRQLEEPGAGTPSPVRL-HALAGFQQRALCHALTFPSLQRLVYSTCSLCQEE-NEDVVRDALQQNP GAFRLAPALPAWPHRGLSTFP-GAEHCLRASPETTLSSGFFVAVIER-VEVPSSASQAKASAPERTPSPAPKRKK RQQXAAA-GACTPPCT (SEQ ID NO: 370). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

This gene maps to chromosome 7, and therefore, may be used as a marker in linkage analysis for chromosome 7.

This gene is expressed in T cells and rejected kidney and to a lesser extent in keratinocytes and various other normal and transformed, predominately haemopoietic cell types.

Polynucleotides and polypeptides of the invention are useful as reagents for differential identification of the tissue(s) or cell type(s) present in a biological sample and for diagnosis of diseases and conditions which include, but are not limited to, immune diseases and/or disorders, particularly host-vs-graft disease, and transplant rejection. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., rejected transplant tissue, immune, heamtopoietic, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in T-cells and rejected kidney, indicates polynucleotides and polypeptides corresponding to this gene are useful for the diagnosis and treatment of a variety of immune system disorders. Representative uses are described in the "Immune Activity" and "Infectious Disease" sections below, in Example 11, 13, 14, 16, 18, 19, 20, 32, 33, 34, 53, and 58, and elsewhere herein. Briefly, the expression of this gene product indicates a role in regulating the proliferation; survival; differentiation; and/or activation of hematopoietic cell lineages, including blood stem cells. Involvement in the regulation of cytokine production, antigen presentation, or other processes suggests a usefulness in the treatment of cancer (e.g. by boosting immune responses).

Expression in cells of lymphoid origin, the natural gene product would be involved in immune functions. Therefore it is also useful as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersensitivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus erythematosis, drug induced hemolytic anemia, rheumatoid arthritis, Sjogren's disease, and scleroderma.

Moreover, the protein may represent a secreted factor that influences the differentiation or behavior of other blood cells, or that recruits hematopoietic cells to sites of injury. Thus, this gene product is thought to be useful in the expansion of stem cells and committed progenitors of various blood lineages, and in the differentiation and/or proliferation of various cell types.

Furthermore, the protein may also be used to determine biological activity, raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 41

The gene encoding the disclosed cDNA is believed to reside on chromosome 12. Accordingly, polynucleotides related to this invention are useful as a marker in linkage analysis for chromosome 12.

This gene is expressed in placenta, uterus, 12 week old, early stage, embryo and to a lesser extent in epithelium.

Polynucleotides and polypeptides of the invention are useful as reagents for differential identification of the tissue(s) or cell type(s) present in a biological sample and for diagnosis of diseases and conditions which include, but are not limited to, developmental and reproductive diseases and/or disorders, in addition to disorders of the integumentary system. Similarly, polypeptides and antibodies directed to these polypeptides are useful in providing immunological probes for differential identification of the tissue(s) or cell type(s). For a number of disorders of the above tissues or cells, particularly of the developmental and epithelial tissues, expression of this gene at significantly higher or lower levels may be routinely detected in certain tissues or cell types (e.g., developmental, reproductive, uterine, placental, integumentary, and cancerous and wounded tissues) or bodily fluids (e.g., lymph, serum, plasma, amniotic fluid, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in placental, uterine, and embryonic cells and tissues indicates this protein may play a role in the regulation of cellular division, and may show utility in the diagnosis, treatment, and/or prevention of developmental diseases and disorders, including cancer, and other proliferative conditions. Representative uses are described in the "Hyperproliferative Disorders" and "Regeneration" sections below and elsewhere herein. Briefly, developmental tissues rely on decisions involving cell differentiation and/or apoptosis in pattern formation. Dysregulation of apoptosis can result in inappropriate suppression of cell death, as occurs in the development of some cancers, or in failure to control the extent of cell death, as is believed to occur in acquired immunodeficiency and certain neurodegenerative disorders, such as spinal muscular atrophy (SMA).

Because of potential roles in proliferation and differentiation, this gene product may have applications in the adult for tissue regeneration and the treatment of cancers. It may also act as a morphogen to control cell and tissue type specification. Therefore, the polynucleotides and polypeptides of the present invention are useful in treating, detecting, and/or preventing said disorders and conditions, in addition to other types of degenerative conditions. Thus this protein may modulate apoptosis or tissue differentiation and is useful in the detection, treatment, and/or prevention of degenerative or proliferative conditions and diseases. The protein is useful in modulating the immune response to aberrant polypeptides, as may exist in proliferating and cancerous cells and tissues. The protein can also be used to gain new insight into the regulation of cellular growth and proliferation. The protein may be useful for the detection, treatment, and/or prevention of various types of cancer, particularly of the integumentary system.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 42

The translation product of this gene was shown to have homology to the human, bovine, mouse, and rat G protein gamma-3 subunit (See Genebank Accession Nos.WO9413, pir|A36204|RGBOG3, gi|2582400 (AF022088), and gi|1353498) which are known to play a role in the regulation of signal transduction pathways.

Moreover, the protein shares structural homology to a yeast mitochondrion membrane protein Q0225 (See Genbank Accession No. pir|S72689|S72689).

In another embodiment, polypeptides comprising the amino acid sequence of the open reading frame upstream of the predicted signal peptide are contemplated by the present invention. Specifically, in specific embodiments, polypeptides of the invention comprise, or alternatively consists of, the following amino acid sequence:

NREQKAKSQLLRSQLYSTLDLPY-FFQCVGTRCTAVCVCVCVCVCXYLPI-HWQVNLHLVYLAMLCFLPIP LLSILSPQTQASRLL-DETVRRKHFLTYPFGISSIITQALL (SEQ ID NO: 373). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridize, under stringent conditions, to the polynucleotide encoding this polypeptide are encompassed by the invention. Antibodies that bind polypeptides of the invention are also encompassed by the invention. Polynucleotides encoding said polypeptides are also encompassed by the invention.

Alternatively, in specific embodiments, polypeptides of the invention comprise, or alternatively consists of, an amino acid sequence selected from the group:

MGTHSVSGRFSKTSPPYCPPSSSLPGPISSIGFNKSL-HECLFISEKELLPLPFPFPDLKSFISYLTSMLKPGPLIVS LKIWVSYPITRPRYLPPMLKSLNISFLYIQYIWAYIH-LYTSFYIYIISVSFFLDKPFIYVISFPKPPHFLFASLSKT QEFHFHVPQHHFFLIFSPQVSSPISCFARLLKSPL-FTPVPTEISPFYNCAYYSADIPSPQLVWGPISH-QTWLLLK LGLLPKRGFQVRGDRL (SEQ ID NO: 371), and/or CFARLLKSPLFTPVPTEISPFYNCAYYSA (SEQ ID NO: 372). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridize, under stringent conditions, to the polynucleotide encoding these polypeptides are encompassed by the invention. Antibodies that bind polypeptides of the invention are also encompassed by the invention. Polynucleotides encoding said polypeptides are also encompassed by the invention.

This gene is expressed in infant brain, fetal tissue, frontal cortex, corpus collosum, and to a lesser extent in amygdala tissue.

Polynucleotides and polypeptides of the invention are useful as reagents for differential identification of the tissue(s) or cell type(s) present in a biological sample and for diagnosis of diseases and conditions which include, but are not limited to, neural and CNS diseases and/or disorders. Similarly, polypeptides and antibodies directed to these polypeptides are useful in providing immunological probes for differential identification of the tissue(s) or cell type(s). For a number of disorders of the above tissues or cells, particularly of the central nervous and peripheral nervous systems, expression of this gene at significantly higher or lower levels may be routinely detected in certain tissues or cell types (e.g., neural, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 175 as residues: Thr-26 to Leu-33. Polynucleotides encoding said polypeptides are also encompassed by the invention.

The tissue distribution in various neural cells and tissues, combined with the similarity to G Protein Gamma-3 subunit indicates polynucleotides and polypeptides corresponding to this gene are useful for the detection, treatment, and/or prevention of neurodegenerative disease states, behavioral disorders, or inflammatory conditions. Representative uses are described in the "Regeneration" and "Hyperproliferative Disorders" sections below, in Example 11, 15, 39, 41, 42, 43, and 51, and elsewhere herein. Briefly, the uses include, but are not limited to, the detection, treatment, and/or prevention of Alzheimer's Disease, Parkinson's Disease, Huntington's Disease, Tourette Syndrome, meningitis, encephalitis, demyelinating diseases, peripheral neuropathies, neoplasia, trauma, congenital malformations, spinal cord injuries, ischemia and infarction, aneurysms, hemorrhages, schizophrenia, mania, dementia, paranoia, obsessive compulsive disorder, depression, panic disorder, learning disabilities, ALS, psychoses, autism, and altered behaviors, including disorders in feeding, sleep patterns, balance, and perception.

In addition, elevated expression of this gene product in regions of the brain indicates it plays a role in normal neural function. Potentially, this gene product is involved in synapse formation, neurotransmission, learning, cognition, homeostasis, or neuronal differentiation or survival.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 43

The translation product of this gene shares homology with the human alpha-3 type IX collagen protein (See Genebank Accession No.gi|1196421) and mitsugumin 23, a novel transmembrane protein on endoplasmic reticulum and nuclear membranes (e.g., Genbank accession number BAA33366; all references available through this accession are hereby incorporated by reference herein.) This protein likely represents a Type IIIb membrane protein. Although the preferred open reading frame of the present invention contains a signal peptide (as delineated in Table 1A and described elsewhere herein), the protein appears to have several transmembrane domains. The transmembrane domains are located at about amino acid position 111-162, 137-162, 163-186, and 64-85 of the sequence referenced in Table 1A for this gene.

Preferred are polypeptides comprising, or alternatively consisting of, an amino acid sequence selected from the group: PGPEAQPWPGPDLPAVGSRGPGR LLAAVSAPRLGLGLAGADPVGPEACHLP (SEQ ID NO: 374), GRLRGPDEV GAPFHPGPATPGLADPLRPAEPXH-WLPSLWGPT (SEQ ID NO: 375), PGPEAQP WPGPDL-PAVGSR (SEQ ID NO: 376), and/or ATPGLADPLRPAEPX-HWLP (SEQ ID NO: 377). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

In another embodiment, polypeptides comprising the amino acid sequence of the open reading frame upstream of the predicted signal peptide are contemplated by the present invention. Specifically, polypeptides of the invention comprise, or alternatively consist of, the following amino acid sequence: QWPEKDPVMAAS SISSPWGKHVFKAILMV-LVALILLHSALAQSRRDFAPPGQQKREAPVDV- LTQI-GRSVRGTLDAWIGPETMHL VSESSSQVLWAISSAIS-VAFFALSGIAAQLLNALGLAGDYLAQGLKLSPGQVQ-TFLLWGAGALVVYWLLSL LLGLVLALLGRIL-WGLKLVIFLAGFVALMRSVPDPSTRALLLLALLI-LYALLSRXTGSRASGAQLEAKVRGL ERQVEELR-WRQRQXAKGARSVEEE (SEQ ID NO: 378). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

The gene encoding the disclosed cDNA is believed to reside on chromosome 11. Accordingly, polynucleotides related to this invention are useful as a marker in linkage analysis for chromosome 11.

This gene is expressed in melanocytes, and to a lesser extent in synovial sarcoma and larynx sarcoma.

Polynucleotides and polypeptides of the invention are useful as reagents for differential identification of the tissue(s) or cell type(s) present in a biological sample and for diagnosis of diseases and conditions which include, but are not limited to, melanoma and other disorders of the integumentary system. Similarly, polypeptides and antibodies directed to these polypeptides are useful in providing immunological probes for differential identification of the tissue(s) or cell type(s). For a number of disorders of the above tissues or cells, particularly of the synovial and epithelial tissues, expression of this gene at significantly higher or lower levels may be routinely detected in certain tissues or cell types (e.g., integumentary, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 176 as residues: Gln-15 to Phe-20, Pro-22 to Ala-30, Val-160 to Thr-165. Polynucleotides encoding said polypeptides are also encompassed by the invention.

The tissue distribution in melanocytes and sarcoma tissue indicates that polynucleotides and polypeptides corresponding to this gene are useful for the study treatment and diagnosis of various cancers and their metastases, particularly of the integumentary system. Additionally, the homology to a conserved collagen protein would suggest that this protein may also be important in the diagnosis or treatment of various autoimmune disorders such as rheumatoid arthritis, lupus, scleroderma, and dermatomyositis as well as dwarfism, spinal deformation, and specific joint abnormalities as well as chondrodysplasias ie. spondyloepiphyseal dysplasia congenita, familial osteoarthritis, Atelosteogenesis type II, metaphyseal chondrodysplasia type Schmid.

Moreover, polynucleotides and polypeptides corresponding to this gene are useful for the treatment, diagnosis, and/or prevention of various skin disorders. Representative uses are described in the "Biological Activity", "Hyperproliferative Disorders", "Infectious Disease", and "Regeneration" sections below, in Example 11, 19, and 20, and elsewhere herein. Briefly, the protein is useful in detecting, treating, and/or preventing congenital disorders (i.e. nevi, moles, freckles, Mongolian spots, hemangiomas, port-wine syndrome), integumentary tumors (i.e. keratoses, Bowen's disease, basal cell carcinoma, squamous cell carcinoma, malignant melanoma, Paget's disease, mycosis fungoides, and Kaposi's sarcoma), injuries and inflammation of the skin (i.e. wounds, rashes, prickly heat disorder, psoriasis, dermatitis), atherosclerosis, uticaria, eczema, photosensitivity, autoimmune disorders (i.e. lupus erythematosus, vitiligo, dermatomyositis, morphea, scleroderma, pemphigoid, and pemphigus), keloids, striae, erythema, petechiae, purpura, and xanthelasma. In addition, such disorders may predispose increased susceptibility to viral and bacterial infections of the skin (i.e. cold sores, warts, chickenpox, molluscum contagiosum, herpes zoster, boils, cellulitis, erysipelas, impetigo, tinea, althlete's foot, and ringworm).

Moreover, the protein product of this gene may also be useful for the treatment or diagnosis of various connective tissue disorders (i.e., arthritis, trauma, tendonitis, chrondomalacia and inflammation, etc.), autoimmune disorders (i.e., rheumatoid arthritis, lupus, scleroderma, dermatomyositis, etc.), dwarfism, spinal deformation, joint abnormalities, amd chondrodysplasias (i.e. spondyloepiphyseal dysplasia congenita, familial osteoarthritis, Atelosteogenesis type II, metaphyseal chondrodysplasia type Schmid).

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 44

The translation product of this gene shares sequence homology with tumor progression inhibitor which is thought to be important in inhibition of tumor growth as well as its metastasis (See Genebank Accession No. W26667; all references available through this accession are hereby incorporated by reference herein). The translation product of this gene also shares sequence homology with melastatin 1 (see, e.g., Genbank accession number AAC80000; all references available through this accession are hereby incorporated by reference herein.) whose expression is inversely correlated with melanoma aggressiveness. Based on the sequence similarity, the translation product of this gene is expected to share at least some biological activities with melastatin proteins. Such activities are known in the art, some of which are described elsewhere herein.

Preferred are polypeptides comprising, or alternatively consisting of, an amino acid sequence selected from the group:

EXPRXIXGXNAPQVPVRNSRVDPRVRPRVRSLVFV-LFCDEVRQWYVNGVNYFTDLWNVMDTLGLFYFIAG IVFRLHSSNKSSLYSGRVIFCLDYIIFTLRLIHIFT-VSRNLGPKII (SEQ ID NO: 379), NILLVNLLVAMF (SEQ ID NO: 380), and/or QVWKFQRYFL (SEQ ID NO: 381). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

In another embodiment, polypeptides comprising the amino acid sequence of the open reading frame upstream of the predicted signal peptide are contemplated by the present invention. Specifically, polypeptides of the invention comprise, or alternatively consist of, the following amino acid sequence:

EXPRXIXGXNAPQVPVRNSRVDPRVR-PRVRSLVFVLFCDEVRQWYVNGVNYFT-DLWNVMDTLGLFYFIAG IVFRLHSSNKSSLYSGRVIF-CLDYIIFTLRLIHIFTVSRNLGPKIIMLQRMLIDVXXFL-FLFAVWMVAFGVAXQ GILRQNEQRWRWIFRS-VIYEPXLAMFGQVPSXVDGTTYDFAHCT-FTGNESKPLCVXLDEHNLPRFPEWITIP LVCIYMLST-NILLVNLLVAMFGYTVGTVQENNDQVWKFQRYFLV-QEYCSRLNIPFPFIVFAYFYMVVKKCF KCCCKEX-NXESSVCCSKMXTMRLWHGRVS (SEQ ID NO: 382). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

This gene is expressed in adult liver, prostate, gall bladder, and to a lesser extent, in Hodkin's lymphoma II.

Polynucleotides and polypeptides of the invention are useful as reagents for differential identification of the tissue(s) or cell type(s) present in a biological sample and for diagnosis of diseases and conditions which include, but are not limited to, liver cancer and other hepatic diseases and/or disorders. Similarly, polypeptides and antibodies directed to these polypeptides are useful in providing immunological probes for differential identification of the tissue(s) or cell type(s). For a number of disorders of the above tissues or cells, particularly of the liver, expression of this gene at significantly higher or lower levels may be routinely detected in certain tissues or cell types (e.g., hepatic, reproductive, metabolic, immune, hematopoietic, and cancerous and wounded tissues) or bodily fluids (e.g., lymph, serum, plasma, bile, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in liver and gall bladder cells and tissues indicates polynucleotides and polypeptides corresponding to this gene are useful for the detection and treatment of liver disorders and cancers. Representative uses are described in the "Hyperproliferative Disorders", "Infectious Disease", and "Binding Activity" sections below, in Example 11, and 51, and elsewhere herein. Briefly, the protein can be used for the detection, treatment, and/or prevention of hepatoblastoma, jaundice, hepatitis, liver metabolic diseases and conditions that are attributable to the differentiation of hepatocyte progenitor cells. In addition, this gene product may have commercial utility in the expansion of stem cells and committed progenitors of various blood lineages, and in the differentiation and/or proliferation of various cell types.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 45

The polypeptide of the present invention is thought to have an intramitochondrial signal indicating that the protein could play a role in metabolic processes, including apoptosis. Based upon this fact, it is expected that the protein product of this gene will share at least some biological activities with other mitochondrial proteins having a similar signal. Such activities are known in the art, some of which are described elsewhere.

In another embodiment, polypeptides comprising the amino acid sequence of the open reading frame upstream of the predicted signal peptide are contemplated by the present invention. In specific embodiments, polypeptides of the invention comprise, or alternatively consist of, the following amino acid sequence: M EFQNMYIQLFGFSFFIVIIVRM-LLLGLCVSARQPVMPRATLWGHLSPAWV-LVPWTPRACGQAAPGRGHVAS DHKSGLPWPKHCS-CLHPRASQPCLFSLNSNRTVFTAIQRVALGWTFWVQ-ANLVPRCT (SEQ ID NO: 383). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding this polypeptide are encompassed by the invention. Antibodies that bind polypeptides of the invention are also encompassed by the invention. Polynucleotides encoding said polypeptides are also encompassed by the invention.

The gene encoding the disclosed cDNA is believed to reside on chromosome 4. Accordingly, polynucleotides related to this invention are useful as a marker in linkage analysis for chromosome 4.

This gene is expressed in human prostate cancer, and to a lesser extent in soares melanocyte and human colon.

Polynucleotides and polypeptides of the invention are useful as reagents for differential identification of the tissue(s) or cell type(s) present in a biological sample and for diagnosis of diseases and conditions which include, but are not limited to, prostate cancer, melanoma, and other diseases and/or disorders of the integumentary system. Similarly, polypeptides and antibodies directed to these polypeptides are useful in providing immunological probes for differential identification of the tissue(s) or cell type(s). For a number of disorders of the above tissues or cells, particularly of the male reproductive system, expression of this gene at significantly higher or lower levels may be routinely detected in certain tissues or cell types (e.g., prostate, reproductive, intregumentary, and cancerous and wounded tissues) or bodily fluids (e.g., lymph, serum, plasma, seminal fluid, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 178 as residues: Ser-36 to Gly-41, Pro-43 to Ser-49. Polynucleotides encoding said polypeptides are also encompassed by the invention.

The tissue distribution in tumors of prostate, colon, and integument origins indicates that polynucleotides and polypeptides corresponding to this gene are useful for diagnosis and intervention of these tumors, in addition to other tumors where expression has been indicated. Representative uses are described elsewhere herein. Briefly, the uses include, but are not limited to the detection, treatment, and/or prevention of male infertility and/or impotence. This gene product is also useful in assays designed to identify binding agents, as such agents (antagonists) are useful as male contraceptive agents.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 46

The gene encoding the disclosed cDNA is believed to reside on chromosome 17. Accordingly, polynucleotides related to this invention are useful as a marker in linkage analysis for chromosome 17.

In another embodiment, polypeptides comprising the amino acid sequence of the open reading frame upstream of the predicted signal peptide are contemplated by the present invention. In specific embodiments, polypeptides of the invention comprise, or alternatively consist of, the following amino acid sequence:

LLLCVTGVYSYGLMHPIPSSFMIKAVSS-FLTAEEASVGNPEGAFMKVLQARKNXTS-TELIVEPEEPSDSSGIN LSGFGSEQLDTNDESDXISTL-SYILPYFSAVNLDVXSXLLPFIKLPTXGNSLAKIQTVG-QNXQXVXRVLMGP RSIQKRHFKEVGRQSIRREQ-

GAQASVENAAEEKRLGSPAPREXEQPHTQQGPEKLAGNAXYTKPSFTQEHK AAVSVLXPFSKGAPSTSSPAKALPQVRDRWKDXTHXISILESAKARVTNMKASKPISHSRKKYRFHKTRSR MTHRTPKVKKSPKFRKKSYLSRLMLANRPPFSAAXSLINSPSQGAFSSLGDLSPQENPFLXVSAPSEHFTETT NIKDTTARNALEENVFMENTNMPEVTISENTNYNHPPEADSXGTAFNLGPTVKQTET (SEQ ID NO: 384). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding this polypeptide are encompassed by the invention. Antibodies that bind polypeptides of the invention are also encompassed by the invention. Polynucleotides encoding said polypeptides are also encompassed by the invention.

This gene is expressed in brain, duodenum carcinoma and cheek carcinoma.

Polynucleotides and polypeptides of the invention are useful as reagents for differential identification of the tissue(s) or cell type(s) present in a biological sample and for diagnosis of diseases and conditions which include, but are not limited to, gastrointestinal disorders and carcinomas, in addition to disorders of the epithelium and mucosa. Similarly, polypeptides and antibodies directed to these polypeptides are useful in providing immunological probes for differential identification of the tissue(s) or cell type(s). For a number of disorders of the above tissues or cells, particularly of the digestive system, expression of this gene at significantly higher or lower levels may be routinely detected in certain tissues or cell types (e.g., gastrointestinal, epithelial, mucosa, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in duodenal tissues and epithelia indicates that the protein product of this gene may be useful for the diagnosis and intervention of tumors and other disorders within these tissues, in addition to other tumors. The expression within embryonic tissue and other cellular sources marked by proliferating cells indicates this protein may play a role in the regulation of cellular division, and may show utility in the diagnosis, treatment, and/or prevention of developmental diseases and disorders, including cancer, and other proliferative conditions. Representative uses are described in the "Hyperproliferative Disorders" and "Regeneration" sections below and elsewhere herein. Briefly, this protein may modulate apoptosis or tissue differentiation and is useful in the detection, treatment, and/or prevention of degenerative or proliferative conditions and diseases. The protein is useful in modulating the immune response to aberrant polypeptides, as may exist in proliferating and cancerous cells and tissues. The protein can also be used to gain new insight into the regulation of cellular growth and proliferation.

The tissue distribution in brain indicates polynucleotides and polypeptides corresponding to this gene are useful for the detection, treatment, and/or prevention of neurodegenerative disease states, behavioral disorders, or inflammatory conditions. Representative uses are described in the "Regeneration" and "Hyperproliferative Disorders" sections below, in Example 11, 15, 39, 41, 42, 43, and 51, and elsewhere herein. Briefly, the uses include, but are not limited to the detection, treatment, and/or prevention of Alzheimer's Disease, Parkinson's Disease, Huntington's Disease, Tourette Syndrome, meningitis, encephalitis, demyelinating diseases, peripheral neuropathies, neoplasia, trauma, congenital malformations, spinal cord injuries, ischemia and infarction, aneurysms, hemorrhages, schizophrenia, mania, dementia, paranoia, obsessive compulsive disorder, depression, panic disorder, learning disabilities, ALS, psychoses, autism, and altered behaviors, including disorders in feeding, sleep patterns, balance, and perception. In addition, elevated expression of this gene product in regions of the brain indicates it plays a role in normal neural function. Potentially, this gene product is involved in synapse formation, neurotransmission, learning, cognition, homeostasis, or neuronal differentiation or survival.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 47

The translation product of this gene shares sequence homology with mouse magnesium dependent protein phosphatase (See Genebank Accession Nos. gn1|PID|d1004752 and emb|CAA06555.1| (AJ005458); all references available through these accessions are hereby incorporated herein by reference; for example, J. Neurosci. Res. 51 (3), 328-338 (1998)) which is thought to be important in normal protein metabolism and possibly gene regulation. Based on the sequence similarity, the translation product of this gene is expected to share at least some biological activities with phosphatase proteins. Such activities are known in the art, some of which are described elsewhere herein.

Preferred polypeptides comprise, or alternatively consist of, an amino acid sequence selected from the group:

CFSNAPKVSDEAVKKDSELDKHLESRVEEIMEKSGEEGMPDLAHVMRILSAENIPNLPPGGGLAGXRNVIE AVYSRLNPHRESDGGAGDLEDPW (SEQ ID NO: 385), CFSNAPKVSDEAVKKDSELDKH LESRVEEIMEKSGEEGMPDLAHVMRILSAENIPN (SEQ ID NO: 386), RNVIE AVYSRLNPHRESDGGAGDLED (SEQ ID NO: 387), DSELDKHLESRVEEIM (SEQ ID NO: 388), KSGEEGMPDLAHVMRILSAENIPN (SEQ ID NO: 389), and/or CFSNAPKVS (SEQ ID NO: 390). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

A preferred polypeptide fragment of the invention comprises, or alternatively consists of, the following amino acid sequence:

MSRKSLAFPIICSYLCFLTVATCSIACTTVFFANLRHTRYICIELSALETSGVISPQINN VPEVHGKYS (SEQ ID NO: 391). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

This gene is expressed in prostate and to a lesser extent in melanocytes.

Polynucleotides and polypeptides of the invention are useful as reagents for differential identification of the tissue(s) or cell type(s) present in a biological sample and for diagnosis of diseases and conditions which include, but are not limited to, proliferative conditions and cancers, in addition to reproductive, visual, and integumentary diseases and/or disorders. Similarly, polypeptides and antibodies directed to these polypeptides are useful in providing immunological probes for differential identification of the tissue(s) or cell type(s). For a number of disorders of the above tissues or cells, particularly of the reproductive system, expression of this gene at significantly higher or lower levels may be routinely detected in certain tissues or cell types (e.g., reproductive, visual, retinal, integumentary, and cancerous and wounded tissues) or bodily fluids (e.g., lymph, serum, plasma, urine, aqueous humor, vitreous humor, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 180 as residues: Asp-6 to His-13, Asp-114 to Gly-131, Thr-166 to Gln-181, Val-210 to Thr-216, Pro-222 to Tyr-227. Polynucleotides encoding said polypeptides are also encompassed by the invention.

The tissue distribution in prostate tissue, combined with the homology to mouse magnesium dependent protein phosphatase indicates that polynucleotides and polypeptides corresponding to this gene are useful for the study and treatment of various cancers and reproductive disorders. This protein may play a role in the regulation of cellular division, and may show utility in the diagnosis, treatment, and/or prevention of developmental diseases and disorders, including cancer, and other proliferative conditions. Representative uses are described in the "Hyperproliferative Disorders" and "Regeneration" sections below and elsewhere herein. Briefly, developmental tissues rely on decisions involving cell differentiation and/or apoptosis in pattern formation. Dysregulation of apoptosis can result in inappropriate suppression of cell death, as occurs in the development of some cancers, or in failure to control the extent of cell death, as is believed to occur in acquired immunodeficiency and certain neurodegenerative disorders, such as spinal muscular atrophy (SMA). This protein may modulate apoptosis or tissue differentiation and is useful in the detection, treatment, and/or prevention of degenerative or proliferative conditions and diseases. The protein is useful in modulating the immune response to aberrant polypeptides, as may exist in proliferating and cancerous cells and tissues. The protein can also be used to gain new insight into the regulation of cellular growth and proliferation. The activity of this protein has been determined to be dependent upon the presence of magnesium ions. This protein is useful in the treatment, detection, and/or prevention of various visual disorders, particularly degenerative conditions, and retinitis pigmentosa.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 48

The translation product of this gene shares sequence homology with ribosomal protein L32 and L14, a mitochondrial protein from rat tissues thought to be important in translation (See Genebank Accession No.gi|868267).

Preferred are polypeptides comprising, or alternatively consisting of, an amino acid sequence selected from the group: IQKMTRVRVVDNSALG (SEQ ID NO: 392), PRCIHVYKKNGVGK (SEQ ID NO: 393), GDQILLAIKGQKKKA (SEQ ID NO: 394), and/or NPVGTRIKTPIPTSL (SEQ ID NO: 395). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

In another embodiment, polypeptides comprising the amino acid sequence of the open reading frame upstream of the predicted signal peptide are contemplated by the present invention. Specifically, polypeptides of the invention comprise, or alternatively consist of, the following amino acid sequence: VLIPSFSS SFLCSRGGPLPXDLSWDPMAFFTGLWGPFTCVSRVLSHHCFSTTGSLSAIQKMTRVRVVDNSALGNSPYHR APRCIHVYKKNGVGKVGDQILLAIKGQKKKALIVGHCMPGPRMTPRFDSNNVVLIEDNGNPVGTRIKTPIPT SLRKREGEYSKVLAIAQNFV (SEQ ID NO: 396). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

This gene maps to chromosome 6, and therefore, may be used as a marker in linkage analysis for chromosome 6.

This gene is expressed in uterus, fetal liver/spleen, human endometrial stromal cells-treated with estradiol and amniotic cells—Primary Culture, and to a lesser extent in, human fetal kidney.

Polynucleotides and polypeptides of the invention are useful as reagents for differential identification of the tissue(s) or cell type(s) present in a biological sample and for diagnosis of diseases and conditions which include, but are not limited to, endometriosis and reproductive disorders, particularly of the female reproductive system. Similarly, polypeptides and antibodies directed to these polypeptides are useful in providing immunological probes for differential identification of the tissue(s) or cell type(s). For a number of disorders of the above tissues or cells, particularly of the female reproductive system, expression of this gene at significantly higher or lower levels may be routinely detected in certain tissues or cell types (e.g., uterine, endometrium, reproductive, immune, hematopoietic, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 181 as residues: Pro-92 to Ser-102, Leu-127 to Tyr-134. Polynucleotides encoding said polypeptides are also encompassed by the invention.

The tissue distribution in endometrium and uterine tissues, combined with the homology to a ribosomal protein indicates that polynucleotides and polypeptides corresponding to this gene are useful for diagnosis and intervention of tumors within said tissue, in addition to other tumors where expression has been indicated. This protein may play a role in cellular division, and may show utility in the diagnosis, treatment, and/or prevention of developmental diseases and disorders, including cancer, and other proliferative conditions. Representative uses are described in the "Hyperproliferative Disorders" and "Regeneration" sections below and elsewhere herein. Briefly, developmental tissues rely on decisions involving cell differentiation and/or apoptosis in pattern formation. Dysregulation of apoptosis can result in inappropriate suppression of cell death, as occurs in the development of some cancers, or in failure to control the extent of cell death, as is believed to occur in acquired immunodeficiency and certain neurodegenerative disorders, such as spinal muscular atrophy (SMA). Because of potential roles in proliferation and differentiation, this gene product may have applications in the adult for tissue regeneration and the treatment of cancers. It may also act as a morphogen to control cell and tissue type specification. Therefore, the polynucleotides and polypeptides of the present invention are useful in treating, detecting, and/or preventing said disorders and conditions, in addition to other types of degenerative conditions. Antagonists, including antibodies directed against this invention, is useful in inhibiting cellular proliferation and thus is useful in inhibiting cancers, in addition to other proliferative diseases and/or disorders. The protein is useful in modulating the immune response to aberrant polypeptides, as may exist in proliferating and cancerous cells and tissues. The protein can also be used to gain new insight into the regulation of cellular growth and proliferation.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 49

This gene is expressed in liver, hepatoma and to a lesser extent in epithelial-TNFa and INF induced.

Polynucleotides and polypeptides of the invention are useful as reagents for differential identification of the tissue(s) or cell type(s) present in a biological sample and for diagnosis of diseases and conditions which include, but are not limited to, liver diseases and/or disorders, particularly cancer. Similarly, polypeptides and antibodies directed to these polypeptides are useful in providing immunological probes for differential identification of the tissue(s) or cell type(s). For a number of disorders of the above tissues or cells, particularly of the hepatic system, expression of this gene at significantly higher or lower levels may be routinely detected in certain tissues or cell types (e.g., hepatic, liver, and cancerous and wounded tissues) or bodily fluids (e.g., lymph, bile, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 182 as residues: Glu-28 to Gly-45, Ser-63 to Gly-69, Gln-96 to Trp-104, Gly-112 to Pro-117, Arg-121 to Pro-128. Polynucleotides encoding said polypeptides are also encompassed by the invention.

The tissue distribution in liver and hepatoma tissue indicates that polynucleotides and polypeptides corresponding to this gene are useful for the detection and treatment of liver disorders and cancers (e.g. hepatoblastoma, jaundice, hepatitis, liver metabolic diseases and conditions that are attributable to the differentiation of hepatocyte progenitor cells). Representative uses are described in the "Hyperproliferative Disorders", "Infectious Disease", and "Binding Activity" sections below, in Example 11, and 51, and elsewhere herein. The protein is useful in modulating the immune response to aberrant polypeptides, as may exist in proliferating and cancerous cells and tissues. The protein can also be used to gain new insight into the regulation of cellular growth and proliferation.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 50

In a preferred embodiment, polypeptides comprising the amino acid sequence of the open reading frame upstream of the predicted signal peptide are contemplated by the present invention. Specifically, polypeptides of the invention comprise, or alternatively consist of, the following amino acid sequence: ARVVQPAARAG MWAGGRSSCQAEVL-RATRGGAARGNAAPGRALEMVPGAAGWC-CLVLWLPACVAAHGFRIHDYLYFQVL SPGDIRY-IFTATPAKDFGGIFHTRYEQIHLVPAEPPEACGELSNGF-FIQDQIALVERGGCSFLSKTRVVQEHGG RAVIISDN-ALTMTASTWR (SEQ ID NO: 397). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding this polypeptide are encompassed by the invention. Antibodies that bind polypeptides of the invention are also encompassed by the invention. Polynucleotides encoding said polypeptides are also encompassed by the invention.

In another embodiment, polypeptides comprising amino acid sequences of alternate downstream open reading frames are contemplated by the present invention. Specifically, polypeptides of the invention comprise, or alternatively consist of, an amino acid sequence selected from the group: MVPGAAGWCCLVLWL PACVAAHGFRIHDYLYFQVL-SPGDIRYIFTATPAKDFGGIFHTRYE-QIHLVPAEPPEACGELSNGFFIQDQIAL VERGGCSFL-SKTRVVQEHGGRAVIISDNAVDNDSFYVEMIQDSTQ-RTADIPALFLLGRDGYMIRRSLEQHGL PWAIISIPVN- VTSIPTFELLQPPWTFW (SEQ ID NO: 398) and VDNDS-FYVEMIQDSTQRTADIPAL FLLGRDGYMIRRSLEQH-GLPWAIISIPVNVTSIPTFELLQPPWTFW (SEQ ID NO: 399). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

The gene encoding the disclosed cDNA is believed to reside on chromosome 2. Accordingly, polynucleotides related to this invention are useful as a marker in linkage analysis for chromosome 2.

This gene is expressed in breast lymph node, ovary, osteoclast cells, and to a lesser extent in human jurkat membrane-bound polysomes and human placenta.

Polynucleotides and polypeptides of the invention are useful as reagents for differential identification of the tissue(s) or cell type(s) present in a biological sample and for diagnosis of diseases and conditions which include, but are not limited to, breast cancer and immune diseases and/or disorders. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., reproductive, endocrine, skeletal, bone, placental, and cancerous and wounded tissues) or bodily fluids (e.g., lymph, serum, plasma, amniotic fluid, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in human breast and placental tissue indicates that the protein product of this gene may be useful for diagnosis and intervention of tumors within these tissues, in addition to other tumors and tissues where expression has been indicated. Expression in cells of lymphoid origin, the natural gene product may be involved in immune functions. Therefore it may be also used as an agent for immunological disorders including arthritis, asthma, immune deficiency diseases such as AIDS, and leukemia.

Furthermore, the protein may also be used to determine biological activity, raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 51

In a preferred embodiment, polypeptides comprising the amino acid sequence of the open reading frame upstream of the predicted signal peptide are contemplated by the present invention. Specifically, polypeptides of the invention comprise, or alternatively consist of the following amino acid sequence: IATAALFFFFYC QVAGFIGKGQSLR-SWVPQRLLGLEPQLQPMQQSRLLLPFLF-FLLEGCAPSSLGPGAAPGSGHSLGPPGSPGA PGPQ-PAVGPSSPCQPGPSPSSPAAAAASSQSSVASWPCTLRC-AAPSPDASALRPAASPAATPAWSPGSGTIRV LRPPA-PAAAPATAITNRGPPRRRRRNARTA (SEQ ID NO: 400). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding this polypeptide are encompassed by the invention. Antibodies that bind polypeptides of the invention are also encompassed by the invention. Polynucleotides encoding said polypeptides are also encompassed by the invention.

In yet another embodiment, polypeptides of the invention comprise, or alternatively consist of, the following amino acid sequence:

ERPPPRRTGTPVARPRGPPDPAVAAG-TALRAKQFARYGAASGVVPGSL-WPSPEQLRELEAEEREWYPSLAT MQESLRVKQLAE-EQKRREREQHIAECMAKMPQMIVNWQQQQRENWE-KAQADKERRARLQAEAQELLGY QVD-PRSARFQELLQDLEKKERNPQGGKTETEEGGATA-ALAAAVAQDPAASGAPSS (SEQ ID NO: 401). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding this polypeptide are encompassed by the invention. Antibodies that bind polypeptides of the invention are also encompassed by the invention. Polynucleotides encoding said polypeptides are also encompassed by the invention.

The polypeptide sequence of the latter embodiment was found to have homology to the human HPK/GCK-like kinase HGK (See Genbank Accession No. gb|AAD16137.1| (AF096300); all references available through this accession are hereby incorporated herein by reference; for example, J. Biol. Chem. 274 (4), 2118-2125 (1999)) which is thought to play a role in modulating gene expression, particularly for genes involved in the c-jun pathway. Based on the sequence similarity, the translation product of this gene is expected to share at least some biological activities with signaling and kinase proteins. Such activities are known in the art, some of which are described elsewhere herein.

In another embodiment, translated products of this gene shares homology with STE20-related protein kinases (see GenBank Accessions AAD16137 and AAC53165; all references available through this accession are hereby incorporated herein by reference; for example, Yao, Z., et al., J. Biol. Chem. 274 (4), 2118-2125 (1999) and Su,Y. C., et al., EMBO J. 16 (6), 1279-1290 (1997)). Based on the sequence similarity, translation products of this gene are expected to share at least some biological activities with STE20-related protein kinases.

In specific embodiments, polypeptides of the invention comprise, or alternatively consist of, the following amino acid sequence:

MQESLRVKQLAEEQKRREREQHIAECMAKMPQM-IVNWQQQQRENWEKAQADKERRARLQAE-AQELLGY QVDPRSARFQELLQDLEKKERKRL-KEEKQKRKKEARAAALAAAVAQDPAASGAPSS (SEQ ID NO: 402). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

The gene encoding the disclosed cDNA is believed to reside on chromosome 19. Accordingly, polynucleotides related to this invention are useful as a marker in linkage analysis for chromosome 19.

This gene is expressed in HL-60, PMA 4H and to a lesser extent in Soares breast 2NbHBst, Human Pituitary, subt IX, and Human Fetal Kidney.

Polynucleotides and polypeptides of the invention are useful as reagents for differential identification of the tissue(s) or cell type(s) present in a biological sample and for diagnosis of diseases and conditions which include, but are not limited to, immune, hematopoietic, developmental, and proliferative diseases and/or disorders, particularly promyelocytic leukemia. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., immune, hematopoietic, reproductive, developmental, proliferative, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 184 as residues: Ser-54 to Ser-63, Asn-132 to Thr-145. Polynucleotides encoding said polypeptides are also encompassed by the invention.

The tissue distribution in HL-60 cells indicates polynucleotides and polypeptides corresponding to this gene are useful for the diagnosis and treatment of a variety of immune system disorders. Representative uses are described in the "Immune Activity" and "Infectious Disease" sections below, in Example 11, 13, 14, 16, 18, 19, 20, 32, 33, 34, 53, and 58, and elsewhere herein. Briefly, the expression of this gene product indicates a role in regulating the proliferation; survival; differentiation; and/or activation of hematopoietic cell lineages, including blood stem cells. Involvement in the regulation of cytokine production, antigen presentation, or other processes suggests a usefulness in the treatment of cancer (e.g. by boosting immune responses). Expression in cells of lymphoid origin, the natural gene product would be involved in immune functions. Therefore it is also useful as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersensitivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus eiythematosis, drug induced hemolytic anemia, rheumatoid arthritis, Sjogren's disease, and scleroderma.

Moreover, the protein may represent a secreted factor that influences the differentiation or behavior of other blood cells, or that recruits hematopoietic cells to sites of injury. Thus, this gene product is thought to be useful in the expansion of stem cells and committed progenitors of various blood lineages, and in the differentiation and/or proliferation of various cell types.

Furthermore, the protein may also be used to determine biological activity, raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 52

The translation product of this gene shares sequence homology with the human hypothetical L1 protein (third intron of gene TS) (See Genebank Accession No. pir|JU0033|JU0033), which is thought to be important for the regulation of RNA-dependent DNA polymerases.

Preferred polypeptides comprise, or alternatively consist of, an amino acid sequence selected from the group:

YQSLAETQQKKENFRPISLKNTDAKILNKILANQIQ-QHIKKLIHNDRVGFIPEMQGWFNICKSINIVHHINRTK DKNHMIISIDAEKAFDKIRQSFMLKTLNKLGIH-GMYLGR (SEQ ID NO: 403), KKENFRPISLKN TDAK-ILNKILANQIQQHIKKLIHNDRVG-FIPEMQGWFNICKSINIVHHINRTKDKN-HMIISIDAEKAFDKIRQSF MLKTLNKLGIHGMY (SEQ ID NO: 404), DAKILNKILAN (SEQ ID NO: 405), IQQHIKKLIH (SEQ ID NO: 406), KDKNHMI-ISIDAEKAFDKI (SEQ ID NO: 407), MLKTLNKLGI (SEQ ID NO: 408), and/or KKENFRPISL (SEQ ID NO: 409). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

In another embodiment, polypeptides comprising the amino acid sequence of the open reading frame upstream of the predicted signal peptide are contemplated by the present invention. Specifically, polypeptides of the invention comprise, or alternatively consist of, the following amino acid sequence:

WTMFIDLHMLNQPCISGMKPTRSLWIS-FLMCCWIWFANILLRIFASVFFR-DIGLKFSFFCCVSARLWYQDDA GLINELGRIPSFY (SEQ ID NO: 410). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

The presence of the amino acid sequences upstream of the predicted signal sequence of the latter embodiment may alter the characteristics of the protein of the present invention such that either the full protein, or fragments thereof, are bound to the membrane in a form analogous to a Type II membrane protein. This form of the protein is thought to have a cytoplasmic tail covering about the first 21 amino acids. Based on the structural similarity, the translation product of this latter embodiment is expected to share at least some biological activities with type II membrane proteins. Such activities are known in the art, some of which are described elsewhere herein.

This gene is expressed in ulcerative colitis.

Polynucleotides and polypeptides of the invention are useful as reagents for differential identification of the tissue(s) or cell type(s) present in a biological sample and for diagnosis of diseases and conditions which include, but are not limited to, gastrointestinal diseases and/or disorders, particularly ulcerative colitis. Similarly, polypeptides and antibodies directed to these polypeptides are useful in providing immunological probes for differential identification of the tissue(s) or cell type(s). For a number of disorders of the above tissues or cells, particularly of the digestive system, expression of this gene at significantly higher or lower levels may be routinely detected in certain tissues or cell types (e.g., gastrointestinal, and cancerous and wounded tissues) or bodily fluids (e.g., lymph, chyme, bile, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in ulcerative colon tissue combined with its homology to an RNA-dependent DNA polymerase regulatory protein may suggest that polynucleotides and polypeptides corresponding to this gene are useful for diagnosis and intervention of tumors and other proliferative conditions within the indicated tissues, and to a lesser extent in other tissues and cell types.

Moreover, the expression within cellular sources marked by proliferating cells indicates this protein may play a role in the regulation of cellular division, and may show utility in the diagnosis, treatment, and/or prevention of developmental diseases and disorders, including cancer, and other proliferative conditions. Representative uses are described in the "Hyperproliferative Disorders" and "Regeneration" sections below and elsewhere herein. Briefly, developmental tissues rely on decisions involving cell differentiation and/or apoptosis in pattern formation. The protein is useful in modulating the immune response to aberrant polypeptides, as may exist in proliferating and cancerous cells and tissues. The protein can also be used to gain new insight into the regulation of cellular growth and proliferation.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 53

In a preferred embodiment, polypeptides comprising the amino acid sequence of the open reading frame upstream of the predicted signal peptide are contemplated by the present invention. Specifically, polypeptides of the invention comprise, or alternatively consist of, the following amino acid sequence:

ERPEEGTEPSPSPVAEQASVSMTPV-
FRAWGLWVYVLPTGFPGPCCMMLLELFP-
KESVPQAYQGILLYLHFG F (SEQ ID NO: 411). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding this polypeptide are encompassed by the invention. Antibodies that bind polypeptides of the invention are also encompassed by the invention. Polynucleotides encoding said polypeptides are also encompassed by the invention.

This gene is expressed in ovary, testis, Hodkin's lymphoma, resting T-Cell; re-excision and to a lesser extent in soares multiple sclerosis, human corpus colosum, and fetal kidney.

Polynucleotides and polypeptides of the invention are useful as reagents for differential identification of the tissue(s) or cell type(s) present in a biological sample and for diagnosis of diseases and conditions which include, but are not limited to, reproductive, immune, and hematopoietic diseases and/or disorders. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., reproductive, ovarian, testicular, breast, immune, hematopoietic, and cancerous and wounded tissues) or bodily fluids (e.g., lymph, serum, seminal fluid, breast milk, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in testicular tissue indicates that polynucleotides and polypeptides corresponding to this gene are useful for the treatment and diagnosis of conditions concerning proper testicular function (e.g. endocrine function, sperm maturation), as well as cancer. Therefore, this gene product is useful in the treatment of male infertility and/or impotence. This gene product is also useful in assays designed to identify binding agents, as such agents (antagonists) are useful as male contraceptive agents. Similarly, the protein is believed to be useful in the treatment and/or diagnosis of testicular cancer. The testes are also a site of active gene expression of transcripts that is expressed, particularly at low levels, in other tissues of the body. Therefore, this gene product may be expressed in other specific tissues or organs where it may play related functional roles in other processes, such as hematopoiesis, inflammation, bone formation, and kidney function, to name a few possible target indications. Moreover, the protein product of this gene has also been shown to be expressed in ovary and breast tissue which, in combination with the detected expression in testis, indicates that this protein represents a secreted factor that plays an important role in proper reproduction (e.g., hormone, signaling factor, etc.).

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 54

When tested against U937 cell lines, supernatants removed from cells containing this gene activated the GAS (gamma activating sequence) promoter element. Thus, it is likely that this gene activates myeloid cells, and to a lesser extent, other cells and tissue cell-types, through the JAK-STAT signal transduction pathway. GAS is a promoter element found upstream of many genes which are involved in the Jak-STAT pathway. The Jak-STAT pathway is a large, signal transduction pathway involved in the differentiation and proliferation of cells. Therefore, activation of the Jak-STAT pathway, reflected by the binding of the GAS element, can be used to indicate proteins involved in the proliferation and differentiation of cells.

In a preferred embodiment, polypeptides comprising the amino acid sequence of the open reading frame upstream of the predicted signal peptide are contemplated by the present invention. Specifically, polypeptides of the invention comprise, or alternatively consist of, the following amino acid sequence: RGEVPHQ PHPTRRTVVSGQAPWXPGPXAL-GQXVETAAGMGMPLVTVTAATFPTLSCP-PRAWPEVEAPEAPALPVVPE LPEVPMEMPLVLP-PELELLSLEAVHRYQXGGTLMGWTRAEASANGS (SEQ ID NO: 412). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding this polypeptide are encompassed by the invention. Antibodies that bind polypeptides of the invention are also encompassed by the invention. Polynucleotides encoding said polypeptides are also encompassed by the invention.

In yet another embodiment, polypeptides of the invention comprise, or alternatively consist of, the following amino acid sequence:

MVLDPYRAVALELQANREPDFSSLVSPL-SPRRMAARVFYLLLGECMHVCVCM-WGRDTETRGPYRDSPDLP SPRLLTSALSATDSS-RETRKAIWSPPDPAGAQIPLRLESIYKAARKPATSSKP-RRASLKKKKK (SEQ ID NO: 413). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

Polypeptides of the latter embodiment share homology to the human hHR21spB (See Genbank Accession No.gi|4101480|gb|AAD01193.1| (AF006264); all references available through this accession are hereby incorporated by reference herein) which is thought to play a role in DNA repair. Based on the sequence similarity, the translation product of this gene is expected to share at least some biological activities with DNA repair proteins. Such activities are known in the art, some of which are described elsewhere herein.

The gene encoding the disclosed cDNA is believed to reside on chromosome 22. Accordingly, polynucleotides related to this invention are useful as a marker in linkage analysis for chromosome 22.

This gene is expressed in resting T-cells, testis, uterine cancer, bone marrow, and to a lesser extent in cerebellum.

Polynucleotides and polypeptides of the invention are useful as reagents for differential identification of the tissue(s) or cell type(s) present in a biological sample and for diagnosis of diseases and conditions which include, but are not limited to, immune, reproductive, and neural diseases and/or disorders. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., immune, hematopoietic, neural, reproductive, and cancerous and wounded tissues) or bodily fluids (e.g., lymph, serum, plasma, seminal fluid, amniotic fluid, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in bone marrow and resting T-cells, combined with the detected GAS biological activity, indicates polynucleotides and polypeptides corresponding to this gene are useful for the diagnosis and treatment of a variety of immune system disorders. Representative uses are described in the "Immune Activity" and "Infectious Disease" sections below, in Example 11, 13, 14, 16, 18, 19, 20, 32, 33, 34, 53, and 58, and elsewhere herein. Briefly, the expression of this gene product indicates a role in regulating the proliferation; survival; differentiation; and/or activation of hematopoietic cell lineages, including blood stem cells. Involvement in the regulation of cytokine production, antigen presentation, or other processes suggests a usefulness in the treatment of cancer (e.g. by boosting immune responses). Expression in cells of lymphoid origin, the natural gene product would be involved in immune functions. Therefore it is also useful as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersensitivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus erythematosis, drug induced hemolytic anemia, rheumatoid arthritis, Sjogren's disease, and scleroderma.

Moreover, the protein may represent a secreted factor that influences the differentiation or behavior of other blood cells, or that recruits hematopoietic cells to sites of injury. Thus, this gene product is thought to be useful in the expansion of stem cells and committed progenitors of various blood lineages, and in the differentiation and/or proliferation of various cell types. Polynucleotides and polypeptides corresponding to this gene are useful for the detection, treatment, and/or prevention of neurodegenerative disease states, behavioral disorders, or inflammatory conditions.

Furthermore, the protein may also be used to determine biological activity, raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 55

The translation product of this gene was shown to have homology to the human platelet membrane glycoprotein V, which is a part of the Ib-V-IX system of surface glycoproteins (GPs Ib alpha, Ib beta, V, IX) that constitute the receptor for von Willebrand factor (vWf) and mediate the adhesion of platelets to injured vascular surfaces in the arterial circulation, a critical initiating event in hemostasis (See Genebank Accession No.gi|388760).

Moreover, the protein product of this gene was also shown to have homology to human toll and toll-like receptors (See Genbank Accession Nos. W86352, and gb|AF051151|AF051151; all references available through this accession are hereby incorporated herein by reference; for example, Blood 91 (11), 4020-4027 (1998)). Based on the sequence similarity, the translation product of this gene is expected to share at least some biological activities with toll-receptor proteins. Such activities are known in the art, some of which are described elsewhere herein.

Preferred are polypeptides comprising, or alternatively consisting of, an amino acid sequence selected from the group: AFRNLPNLRIL (SEQ ID NO: 414), and/or AFQGLFHLFELRL (SEQ ID NO: 415). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

In another embodiment, polypeptides comprising the amino acid sequence of the open reading frame upstream of the predicted signal peptide are contemplated by the present invention. In specific embodiments, polypeptides of the invention comprise, or alternatively consist of, the following amino acid sequence:

NKXILEVPSARTTRIMGDHLDLLLGVVL-MAGPVFGIPSCSFDGRIAFYRFCNLTQVPQVLNT-TERLLLSFNYI RTVTASSFPFLEQLQLLELGSQYT-PLTIDKEAFRNLPNLRILDLGSSKIYFL-HPDAFQGLFHLFELRLYFCGLS DAVLKDGYFRNLKA-LTRLDLSKNQIRSLYLHPSFGKLNSLKSIDFSSNQIFLV-CEHELE (SEQ ID NO: 416). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding this polypeptide are encompassed by the invention. Antibodies that bind polypeptides of the invention are also encompassed by the invention. Polynucleotides encoding said polypeptides are also encompassed by the invention.

This gene is expressed in pancreatic tumors.

Polynucleotides and polypeptides of the invention are useful as reagents for differential identification of the tissue(s) or cell type(s) present in a biological sample and for diagnosis of diseases and conditions which include, but are not limited to, pancreatic cancer; impaired pancreatic function; altered carbohydrate metabolism; and immune and hematopoietic diseases and/or disorders. Similarly, polypeptides and antibodies directed to these polypeptides are useful in providing immunological probes for differential identification of the tissue(s) or cell type(s). For a number of disorders of the above tissues or cells, particularly of the pancreas or endocrine system, expression of this gene at significantly higher or lower levels may be routinely detected in certain tissues or cell types (e.g., pancreatic, gastrointestinal, immune, hematopoietic, and cancerous and wounded tissues) or bodily fluids (e.g., lymph, serum, plasma, urine, bile, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in pancreatic tumors indicates that polynucleotides and polypeptides corresponding to this gene are useful for the diagnosis and/or treatment of disorders of the pancreas. Expression of this gene product in pancreas tumors indicates a potential involvement in pancreatic cancer, and indicates that the gene product may play more general roles in cellular proliferation and/or apoptosis as well. Alternately, expression in the pancreas may suggest a general involvement in pancreatic function, and implicate the utility of this gene product in a variety of pancreatic disorders. Alternately, as this protein is a secreted protein, it may simply be produced by the pancreas to have effects at other sites within the body or endocrine system. In addition, the homology to a conserved receptor for von Willebrand factor indicates that polynucleotides and polypeptides corresponding to this gene are useful for the treatment and diagnosis of hematopoetic related disorders such as anemia, pancytopenia, leukopenia, thrombocytopenia or leukemia since stromal cells are important in the production of cells of hematopoietic lineages. The uses include bone marrow cell ex vivo culture, bone marrow transplantation, bone marrow reconstitution, radiotherapy or chemotherapy of neoplasia.

The gene product may also be involved in lymphopoiesis, therefore, it can be used in immune disorders such as infection, inflammation, allergy, immunodeficiency etc. The product of this gene may also show utility in the treatment of vascular diseases such as athlerosclerosis and stroke. The protein is useful in modulating the immune response to aberrant polypeptides, as may exist in proliferating and cancerous cells and tissues. The protein can also be used to gain new insight into the regulation of cellular growth and proliferation.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 56

In another embodiment, polypeptides comprising the amino acid sequence of the open reading frame upstream of the predicted signal peptide are contemplated by the present invention. In specific embodiments, polypeptides of the invention comprise, or alternatively consist of, the following amino acid sequence:

AHAALQLSLRTCGPCSSPYPHAG-LAALLTHMWALQLSLPTCGLAALLTHMR-PCSSPYPHAGLAALLTHMG PCRSPYPHGGLAAVLTH-MRALQLSLPTWGLAALLTHMRPCSSPYPHAGLACC-WLWSLSSHRSLQVQATHR LVVRTIKDRVMLKV-LPQTRRRGPFLSSCRNDVMRNCVPRHAV-LVTTCVFVSFPTHCKVGITGPITQVKQKP GNH-SSPCPVIQLVAKAEFELMLPSVPKPVYLTLVLSCWCL-CDVPCLSVSL (SEQ ID NO: 417). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding this polypeptide are encompassed by the invention. Antibodies that bind polypeptides of the invention are also encompassed by the invention. Polynucleotides encoding said polypeptides are also encompassed by the invention.

It has been determined that the protein product of this gene has a conserved G-protein receptor motif beginning at amino acid position 89 and ending at amino acid position 105 of the amino acid sequence referenced in Table 1A for this gene.

In addition, in specific embodiments, polypeptides of the invention comprise, or alternatively consist of, the following amino acid sequence: LACCWLWSLSSHRSLQV (SEQ ID NO: 418). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding this polypeptide are encompassed by the invention. Antibodies that bind polypeptides of the invention are also encompassed by the invention. Polynucleotides encoding said polypeptides are also encompassed by the invention.

This gene is expressed in tonsils and anergic T-cells.

Polynucleotides and polypeptides of the invention are useful as reagents for differential identification of the tissue(s) or cell type(s) present in a biological sample and for diagnosis of diseases and conditions which include, but are not limited to, immune system disorders; immune dysfunction; impaired immune surveillance. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., immune, hematopoietic, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 189 as residues: Pro-22 to Pro-28, Pro-41 to His-48, Pro-79 to His-86, Pro-126 to Phe-134, Ser-137 to Met-143, Gln-176 to Ser-186. Polynucleotides encoding said polypeptides are also encompassed by the invention.

The tissue distribution in T-cells and tonsils, combined with the identification of a G-protein receptor motif within the open reading frame, indicates polynucleotides and polypeptides corresponding to this gene are useful for the diagnosis and treatment of a variety of immune system disorders. Representative uses are described in the "Immune Activity" and "Infectious Disease" sections below, in Example 11, 13, 14, 16, 18, 19, 20, 32, 33, 34, 53, and 58, and elsewhere herein. Briefly, the expression of this gene product indicates a role in regulating the proliferation; survival; differentiation; and/or activation of hematopoietic cell lineages, including blood stem cells. Involvement in the regulation of cytokine production, antigen presentation, or other processes suggests a usefulness in the treatment of cancer (e.g. by boosting immune responses). Expression in cells of lymphoid origin, the natural gene product would be involved in immune functions. Therefore it is also useful as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersensitivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus eiythematosis, drug induced hemolytic anemia, rheumatoid arthritis, Sjogren's disease, and scleroderma.

Moreover, the protein may represent a secreted factor that influences the differentiation or behavior of other blood cells, or that recruits hematopoietic cells to sites of injury. Thus, this gene product is thought to be useful in the expansion of stem cells and committed progenitors of various blood lineages, and in the differentiation and/or proliferation of various cell types.

Furthermore, the protein may also be used to determine biological activity, raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 57

A translated product of this gene shares homology with Krueppel family zinc finger proteins (see GenBank Accession AAB86596; all references available through this accession are hereby incorporated herein by reference, for example, Hussey,D. J., et al., Genomics 45 (2), 451-455 (1997)). Based on the sequence similarity, a translation product of this gene is expected to share at least some biological activities with zinc finger proteins. Such activities are known in the art, some of which are described elsewhere herein.

In specific embodiments, polypeptides of the invention comprise, or alternatively consist of, the following amino acid sequence:

EIGSHSVAQAGLE LPGSSDPPTSGSQSAGIT-GVSQGTQPSVDLCQEEPAGADQPHGSLQ (SEQ ID NO: 419). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding this polypeptide are encompassed by the invention. Antibodies that bind polypeptides of the invention are also encompassed by the invention. Polynucleotides encoding this polypeptide are also provided.

This gene is expressed in healing groin wound (6.5 hours post incision), and to a lesser extent in testis.

Polynucleotides and polypeptides of the invention are useful as reagents for differential identification of the tissue(s) or cell type(s) present in a biological sample and for diagnosis of diseases and conditions which include, but are not limited to, wounded tissues; disorders involving tissue repair; male reproductive disorders; mucositis; tissue degeneration. Similarly, polypeptides and antibodies directed to these polypeptides are useful in providing immunological probes for differential identification of the tissue(s) or cell type(s). For a number of disorders of the above tissues or cells, particularly of the reproductive system, expression of this gene at significantly higher or lower levels may be routinely detected in certain tissues or cell types (e.g., reproductive, testis, and cancerous and wounded tissues) or bodily fluids (e.g., lymph, serum, plasma, urine, seminal fluid, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 190 as residues: Ser-59 to Gly-68. Polynucleotides encoding said polypeptides are also encompassed by the invention.

The tissue distribution in healing groin wound and testis indicates that polynucleotides and polypeptides corresponding to this gene are useful for therapeutic use as an agent to facilitate wound healing and tissue regeneration. Expression of this product during wound healing indicates that it may play a beneficial role during the process. Alternately, expression during wound healing may also suggest that it plays a negative role during the process, e.g. fibrosis and scarring, and that therapeutics designed to counter the effects of this protein may be even more beneficial. In addition, expression of this protein within the groin and testis indicates that it may play a role in reproductive system function—particularly male reproductive function—and that this protein may even have potential uses as a male contraceptive. Alternately, the tissue distribution in testicular tissue indicates that polynucleotides and polypeptides corresponding to this gene are useful for the treatment and diagnosis of conditions concerning proper testicular function (e.g. endocrine function, sperm maturation), as well as cancer. Therefore, this gene product is useful in the treatment of male infertility and/or impotence. This gene product is also useful in assays designed to identify binding agents, as such agents (antagonists) are useful as male contraceptive agents. Similarly, the protein is believed to be useful in the treatment and/or diagnosis of testicular cancer. The testes are also a site of active gene expression of transcripts that is expressed, particularly at low levels, in other tissues of the body. Therefore, this gene product may be expressed in other specific tissues or organs where it may play related functional roles in other processes, such as hematopoiesis, inflammation, bone formation, and kidney function, to name a few possible target indications.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 58

In specific embodiments, polypeptides of the invention comprise, or alternatively consist of, the following amino acid sequence:

MGEASPPAPARRHLLVLLLLLSTLVIP-
SAAAPIHDADAQESSLGLTGLQSLLQGF-
SRLFLKVTCFGA (SEQ ID NO: 420). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding this polypeptide are encompassed by the invention. Antibodies that bind polypeptides of the invention are also encompassed by the invention. Polynucleotides encoding said polypeptides are also encompassed by the invention.

This gene is expressed in testis, and to a lesser extent in brain and fetal heart.

Polynucleotides and polypeptides of the invention are useful as reagents for differential identification of the tissue(s) or cell type(s) present in a biological sample and for diagnosis of diseases and conditions which include, but are not limited to, neurodegenerative disorders; psychological disorders; learning disabilities; altered heart function; altered male reproductive function. Similarly, polypeptides and antibodies directed to these polypeptides are useful in providing immunological probes for differential identification of the tissue(s) or cell type(s). For a number of disorders of the above tissues or cells, particularly of the brain and nervous system, cardiovascular system, or reproductive system, expression of this gene at significantly higher or lower levels may be routinely detected in certain tissues or cell types (e.g., reproductive, testis, developmental, and cancerous and wounded tissues) or bodily fluids (e.g., lymph, serum, plasma, urine, seminal fluid, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 191 as residues: Pro-82 to His-93. Polynucleotides encoding said polypeptides are also encompassed by the invention.

The tissue distribution in testicular tissue indicates that polynucleotides and polypeptides corresponding to this gene are useful for the treatment and diagnosis of conditions concerning proper testicular function (e.g. endocrine function, sperm maturation), as well as cancer. Therefore, this gene product is useful in the treatment of male infertility and/or impotence. This gene product is also useful in assays designed to identify binding agents, as such agents (antagonists) are useful as male contraceptive agents. Similarly, the protein is believed to be useful in the treatment and/or diagnosis of testicular cancer. The testes are also a site of active gene expression of transcripts that is expressed, particularly at low levels, in other tissues of the body. Therefore, this gene product may be expressed in other specific tissues or organs where it may play related functional roles in other processes, such as hematopoiesis, inflammation, bone formation, and kidney function, to name a few possible target indications. Alternatively, the tissue distribution in brain indicates that polynucleotides and polypeptides corresponding to this gene are useful for the diagnosis and/or treatment of brain and nervous system disorders. Expression of this gene product in a variety of brain regions indicates a role in brain and nervous system function. This indicates that the protein product may be useful in the treatment of neurodegenerative disorders; learning disabilities; psychoses; and behaviors, including feeding; sleeping; perception; balance; etc. Therefore, this gene product may be useful in the treatment of a variety of heart conditions, including myocardial infarction; congestive heart failure; arrhythmias; coronary occlusion; and a variety of other disorders of the heart. The secreted protein can also be used to determine biological activity, to raise antibodies, as tissue markers, to isolate cognate ligands or receptors, to identify agents that modulate their interactions, and as nutritional supplements. It may also have a very wide range of biological activities. Representative uses are described in the "Chemotaxis" and "Binding Activity" sections below, in Example 11, 12, 13, 14, 15, 16, 18, 19, 20, 32, 33, 34, 53, and 58, and elsewhere herein. Briefly, the protein may possess the following activities: cytokine, cell proliferation/differentiation modulating activity or induction of other cytokines; immunostimulating/immunosuppressant activities (e.g. for treating human immunodeficiency virus infection, cancer, autoimmune diseases and allergy); regulation of hematopoiesis (e.g. for treating anemia or as adjunct to chemotherapy); stimulation or growth of bone, cartilage, tendons, ligaments and/or nerves (e.g. for treating wounds, stimulation of follicle stimulating hormone (for control of fertility); chemotactic and chemokinetic activities (e.g. for treating infections, tumors); hemostatic or thrombolytic activity (e.g. for treating hemophilia, cardiac infarction etc.); anti-inflammatory activity (e.g. for treating septic shock, Crohn's disease); as antimicrobials; for treating psoriasis or other hyperproliferative diseases; for regulation of metabolism, and behavior. Also contemplated is the use of the corresponding nucleic acid in gene therapy procedures.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 59

The translation product of this gene shares sequence homology with alpha 1,3 galactosyltransferase which is thought to be important in the regulation of protein glycosylation and sugar transfer (See Genebank Accession No. bs|150271; all references available through this accession are hereby incorporated by reference herein).

Preferred polypeptides comprise, or alternatively consists of, amino acid sequence selected from the group:

MLVVSTVIIVFWEFINSTEGSFLWIYHS-KNPEVDDSSAQKGWWFLSWFNNGIH-NYQQGEEDIDKEKGREET KGRKMTQQSFGYGT-GLIQT (SEQ ID NO: 421), and/or FPGRTHASGNVKGKVILS (SEQ ID NO: 422). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

In another embodiment, polypeptides comprising the amino acid sequence of the open reading frame upstream of the predicted signal peptide are contemplated by the present invention. Specifically, polypeptides of the invention comprise, or alternatively consist of, the following amino acid sequence: ADQEKIRNV KGKVILSMLVVSTVIIVFWE-FINSTEGSFLWIYHSKNPEVDDSSAQKG-WWFLSWFNNGIHNYQQGEEDIDKE KGREETKGRK-MTQQSFGYGTGLIQT (SEQ ID NO: 423). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridize, under stringent conditions, to the polynucleotide encoding this polypeptide are encompassed by the invention. Antibodies that bind polypeptides of the invention are also encompassed by the invention. Polynucleotides encoding said polypeptides are also encompassed by the invention.

The presence of the upstream amino acids of the latter embodiment may significantly alter the secreted characteristics of the present invention. Namely, either the full-length protein, or fragments thereof, may become membrane bound in a mechanism analogous to type II membrane proteins. Based on the such characteristics, the translation product of this latter embodiment is expected to share at least some biological activities with type II membrane proteins. Such activities are known in the art, some of which are described elsewhere herein. fragments.

The gene encoding the disclosed cDNA is believed to reside on chromosome 9. Accordingly, polynucleotides related to this invention are useful as a marker in linkage analysis for chromosome 9.

This gene is expressed in primary dendritic cells, neutrophils, and T cells and to a lesser extent in liver hepatoma and infant brain.

Polynucleotides and polypeptides of the invention are useful as reagents for differential identification of the tissue(s) or cell type(s) present in a biological sample and for diagnosis of diseases and conditions which include, but are not limited to, immune dysfunction, hematopoietic disorders; inflammation; neurodegenerative disorders; liver hepatoma; T cell lymphoma. Similarly, polypeptides and antibodies directed to these polypeptides are useful in providing immunological probes for differential identification of the tissue(s) or cell type(s). For a number of disorders of the above tissues or cells, particularly of the immune system, liver, or CNS, expression of this gene at significantly higher or lower levels may be routinely detected in certain tissues or cell types (e.g., immune, hematopoietic, neural, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 192 as residues: His-27 to Gly-41, Gln-56 to Tyr-83. Polynucleotides encoding said polypeptides are also encompassed by the invention.

The tissue distribution in dendritic cells, combined with the homology to galactosyltransferases indicates that polynucleotides and polypeptides corresponding to this gene are useful for the diagnosis and/or treatment of a variety of disorders, particularly of the immune and nervous systems since normal function of such tissues depends upon proper glycoprotein recognition and galactosyltransferase function. Representative uses are described in the "Immune Activity" and "Infectious Disease" sections below, in Example 11, 13, 14, 16, 18, 19, 20, 32, 33, 34, 53, and 58, and elsewhere herein. Expression of this gene product in dendritic cells indicates a role in the regulation of the immune system and responses to infectious agents. This may involve roles in antigen presentation, antigen processing, stimulation and activation of B and T cells, or stimulation/activation of dendritic cells themselves. This may be evidenced by effects on cytokine production. Expression of this gene product in other hematopoietic cells such as T cells and neutrophils also indicates roles in the functions of those cells as well, and involvement in the proliferation, survival, and/or differentiation of hematopoietic cells in general. In addition, the expression also indicates that polynucleotides and polypeptides corresponding to this gene are useful for the treatment and diagnosis of hematopoetic related disorders such as anemia, pancytopenia, leukopenia, thrombocytopenia or leukemia since stromal cells are important in the production of cells of hematopoietic lineages. The uses may include bone marrow cell ex vivo culture, bone marrow transplantation, bone marrow reconstitution, radiotherapy or chemotherapy of neoplasia.

The gene product may also be involved in lymphopoiesis, therefore, it can be used in immune disorders such as infection, inflammation, allergy, immunodeficiency etc. Expression of this gene product within infant brain also indicates a role in neuron survival, synapse formation, neurotransmission, perception, etc. The protein is useful in the treatment and/or prevention of degenerative myelinating diseases and/or disorders, particularly multiple sclerosis, in addition to other disorders which occur secondary to aberrant fatty-acid metabolism.

Furthermore, the protein may also be used to determine biological activity, raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 60

The translation product of this gene shares homology with serine/threonine kinases (see GenBank Accessions AAA36658 and AAB97983; all references available through these accessions are hereby incorporated herein by reference, for example Levedakou, E. N., et al., Oncogene 9, 1977-1988 (1994)).

This gene is expressed in small intestine and leukocytes.

Polynucleotides and polypeptides of the invention are useful as reagents for differential identification of the tissue(s) or cell type(s) present in a biological sample and for diagnosis of diseases and conditions which include, but are not limited to, hematopoietic disorders; inflammation; allergy; impaired immunity; autoimmunity, and gastrointestinal disorders. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., gastrointestinal, immune, hematopoietic, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in leukocytes indicates that polynucleotides and polypeptides corresponding to this gene are useful for the diagnosis and/or treatment of a variety of hematopoietic disorders. Representative uses are described in the "Immune Activity" and "Infectious Disease" sections below, in Example 11, 13, 14, 16, 18, 19, 20, 32, 33, 34, 53, and 58, and elsewhere herein. Expression of this gene product in small intestines and leukocytes indicates that it may be expressed by various hematopoietic cells, for example, in the peyer's patches of intestine as well as within the circulation itself. Thus, it may play a role in the proliferation; survival; differentiation; or activation of various hematopoietic cell lineages. This may affect the cells' ability to recognize antigen; mount an immune response; participate in inflammatory processes; and effectively patrol the body for infectious or foreign agents. Alternately, expression of this gene product in small intestine may reflect a role in digestion and food processing.

Furthermore, the protein may also be used to determine biological activity, raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 61

The translation product of this gene shares sequence homology with the *Drosophila* strabismus gene product which is thought to regulate tissue polarity and cell fate decisions (See Genebank Accession No.gi|2854044 (AF044208); all references available through this reference are hereby incorporated herein by reference).

When tested against U937, SK, Raji, and Reh cell lines, supernatants removed from cells containing this gene activated the GAS (gamma activating sequence) promoter element. Thus, it is likely that this gene activates myeloid cells, and to a lesser extent, other cells and tissue cell types, through the JAK-STAT signal transduction pathway. GAS is a promoter element found upstream of many genes which are involved in the Jak-STAT pathway. The Jak-STAT pathway is a large, signal transduction pathway involved in the differentiation and proliferation of cells. Therefore, activation of the Jak-STAT pathway, reflected by the binding of the GAS element, can be used to indicate proteins involved in the proliferation and differentiation of cells.

Preferred polypeptides of the invention comprise, or alternatively consist of, amino acid sequence selected from the group:

MQSPLVECPPPSIHYWPSVPAGAQGAC-SPMFHAAGWSRSQPNGEIPASSXGHL-SIQRAALVVLENYYKDFTI YNPNLLTASKFRAA-KHMAGLKVYNVDGPSNNATGQSRAMIAAAARRRD-SSHNELYYEEAEHERRVKKRK ARLVVAVEEAFI-HIQRLQAEEQQKAPGEVMDPREAAQAIF-PSMARALQKYLRITRQQNYHSMESILQAPGL LHHQRHDPQGLPRTVPQCGPHPAI (SEQ ID NO: 424), LSIQRAALVVLENYYKDFTIYNP (SEQ ID NO: 425), DSSHNELYYEEAEHE (SEQ ID NO: 426), and/or FPSMARALQK YLRITRQQ (SEQ ID NO: 427). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

A preferred polypeptide fragment of the invention comprises the following amino acid sequence:

MAFKLLILLIGTWALFFRKRRADM-PRVFVFRALLLVLIFLFCGFPIGFFTG-SAFWTLGNRNYQGIVQYAVSPC GMPSSFHPLLAIR-PCWSSGSLQPNVPRCRLVPLPTEWGNPRFQXGTPEY-PASSIGGPRKLLQRFHHL (SEQ ID NO: 428). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

The translation product of this gene was determined to have a transmembrane domain located at amino acid position 249-266 of the amino sequence referenced in Table 1A for this gene. Likewise, this protein is thought to be a Type II membrane protein.

In another embodiment, preferred polypeptides of the present invention comprise, or alternatively consist of, an amino acid sequence selected from the group:

MQSPLWMPSSSSITWPSSCWSSGSCSPC-SRCRSRSTDGESRFYSLGHL (SEQ ID NO: 429), MQSPLWMPSSSSITWPSSCWSSGSCSPCSR-CRSRSTDGESRFYSLGHLSIQRAALVVLENYYKDFTIYNPN LLTASKFRAAKHMAGLKVYNVDGPSN-NATGQSRAMIAAAARRRDSSHNELYYEE-AEHERRVKKRKARLV VAVEEAFIHIQRLQAE-EQQKAPGEVMDPREAAQAIFPSMARALQKYLRITRQ-QNYHSMESILQHLAFCITNG MTPKAFLERYL-SAGPTLQYDKDRWLSTQWRLVSDEALT-NGLRDGIVFVLKCLDFSLVVNVKKIPFIILSEEFI DPK-SHKFVLRLQSETSV (SEQ ID NO: 430), MAFKLLILLIGTWALFFRKRRADM-PRVFVFRALLLVLIFLF V VSYWLF YGVRILD-SRDRNYQGIVQYAVSLVDALLFIHY-LAIVLLELRQLQPMFTLQVVRSTDGESR FYSL GH (SEQ ID NO: 432), and MPRVFVFRALLLVLIFLFVVSY-WLFYGVRILD SRDRNYQGIVQYAVSLVDAL LFIHY-LAIVLLELRQLQPMFTLQVVRSTDGESRFYSLGHL (SEQ ID NO: 431). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

This gene is expressed in human osteoclast stromal cells, fetal liver and spleen, and in endometrial tumors and to a lesser extent in hematopoietic cells, including T-cells and CD34 positive cells isolated from cord blood, as well as the thymus, fetal heart, 8 week old whole embryos, and tumors of pancreatic and testicular origin.

Polynucleotides and polypeptides of the invention are useful as reagents for differential identification of the tissue(s) or cell type(s) present in a biological sample and for diagnosis of diseases and conditions which include, but are not limited to, immune system disorders, including AIDS and other hematopoietic diseases and/or disorders, in addition to tumors of osteoclast, endometrial, pancreatic, or testicular origin. Similarly, polypeptides and antibodies directed to these polypeptides are useful in providing immunological probes for differential identification of the tissue(s) or cell type(s). For a number of disorders of the above tissues or cells, particularly of the immune system as well as biological processes involved in cellular proliferation and/or differentiation, expression of this gene at significantly higher or lower levels may be routinely detected in certain tissues or cell types (e.g., immune, haematopoeitic, skeletal, cancerous, and/or other tissues) or bodily fluids (e.g., lymph, serum, plasma, urine, synovial fluid and spinal fluid, lymph, breast milk, and/or seminal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 194 as residues: Pro-17 to Gln-24, Asp-86 to Ser-96, Arg-106 to Asn-112, Ala-119 to Ala-130, Ala-148 to Pro-155, Gln-223 to Leu-230. Polynucleotides encoding said polypeptides are also encompassed by the invention.

The tissue distribution in immune cells and tissues, combined with the detected GAS biological activity, indicates polynucleotides and polypeptides corresponding to this gene are useful for the diagnosis and treatment of a variety of immune system disorders. Representative uses are described in the "Immune Activity" and "Infectious Disease" sections below, in Example 11, 13, 14, 16, 18, 19, 20, 32, 33, 34, 53, and 58, and elsewhere herein. Briefly, the expression of this gene product indicates a role in regulating the proliferation; survival; differentiation; and/or activation of hematopoietic cell lineages, including blood stem cells. Involvement in the regulation of cytokine production, antigen presentation, or other processes suggests a usefulness in the treatment of cancer (e.g. by boosting immune responses). Expression in cells of lymphoid origin, the natural gene product would be involved in immune functions. Therefore it is also useful as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersensitivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus erythematosis, drug induced hemolytic anemia, rheumatoid arthritis, Sjogren's disease, and scleroderma.

Moreover, the protein may represent a secreted factor that influences the differentiation or behavior of other blood cells, or that recruits hematopoietic cells to sites of injury. Thus, this gene product is thought to be useful in the expansion of stem cells and committed progenitors of various blood lineages, and in the differentiation and/or proliferation of various cell types. Alternatively, the tissue expression in liver tissues indicates that polynucleotides and polypeptides corresponding to this gene are useful for the detection and treatment of liver disorders and cancers (e.g. hepatoblastoma, jaundice, hepatitis, liver metabolic diseases and conditions that are attributable to the differentiation of hepatocyte progenitor cells). In addition the expression in fetus would suggest a useful role for the protein product in developmental abnormalities, fetal deficiencies, pre-natal disorders and various would-healing models and/or tissue traumas.

Furthermore, the protein may also be used to determine biological activity, raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 62

In specific embodiments, polypeptides of the invention comprise, or alternatively consist of, the following amino acid sequence: MGLPVSWAPP ALWVLGCCALLLSL-WALCTACRSPRTL (SEQ ID NO: 433). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding this polypeptide are encompassed by the invention. Antibodies that bind polypeptides of the invention are also encompassed by the invention. Polynucleotides encoding said polypeptides are also encompassed by the invention.

This gene is expressed in human thymus, human synovial sarcoma, and to a lesser extent in breast cancer cells.

Polynucleotides and polypeptides of the invention are useful as reagents for differential identification of the tissue(s) or cell type(s) present in a biological sample and for diagnosis of diseases and conditions which include, but are not limited to, immune diseases and/or disorders, particularly autoimmune disorders such as arthritis. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., immune, hematopoietic, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 195 as residues: Pro-40 to Arg-50, Ser-72 to Arg-77, His-82 to Leu-91, Gln-171 to Glu-189, Val-203 to Gly-222, Pro-263 to Thr-269, Ser-282 to Trp-287. Polynucleotides encoding said polypeptides are also encompassed by the invention.

The tissue distribution in thymus indicates polynucleotides and polypeptides corresponding to this gene are useful for the diagnosis and treatment of a variety of immune system disorders. Representative uses are described in the "Immune Activity" and "Infectious Disease" sections below, in Example 11, 13, 14, 16, 18, 19, 20, 32, 33, 34, 53, and 58, and elsewhere herein. Briefly, the expression of this gene product indicates a role in regulating the proliferation; survival; differentiation; and/or activation of hematopoietic cell lineages, including blood stem cells. Involvement in the regulation of cytokine production, antigen presentation, or other processes suggests a usefulness in the treatment of cancer (e.g. by boosting immune responses). Expression in cells of lymphoid origin, the natural gene product would be involved in immune functions. Therefore it is also useful as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersensitivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus erythematosis, drug induced hemolytic anemia, rheumatoid arthritis, Sjogren's disease, and scleroderma.

Moreover, the protein may represent a secreted factor that influences the differentiation or behavior of other blood cells, or that recruits hematopoietic cells to sites of injury. Thus, this gene product is thought to be useful in the expansion of stem cells and committed progenitors of various blood lineages, and in the differentiation and/or proliferation of various cell types. The protein is useful in modulating the immune response to aberrant polypeptides, as may exist in cancerous and/or proliferative cells and tissues.

Furthermore, the protein may also be used to determine biological activity, raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 63

The translation product of this gene shares sequence homology with human, porcine, and mouse zona pellucida binding protein sp 38 which is known to be important in sperm binding to the zona pellucida of an egg cell. Monoclonal antibodies directed against this protein have resulted in inhibition of the sperm/egg binding reaction. As such the translation product of this gene may show commercial utility as a contraceptive. (See Genebank Accession No. gn1|PID|d1005021; all references available through this accession are hereby incorporated by reference herein).

Preferred polypeptides of the invention comprise, or alternatively consist of, an amino acid sequence selected from the group: IYGKTGQPDKIYVELHQNSP (SEQ ID NO: 434), FLEPLSGLYTCTLSYK (SEQ ID NO: 435), LQVVRLD-SCRPGFGKN (SEQ ID NO: 436), and/or CVSVLTYG-AKSC (SEQ ID NO: 437). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

This gene is expressed in a human testes library. It has not been found in other libraries screened at HGS.

Polynucleotides and polypeptides of the invention are useful as reagents for differential identification of the tissue(s) or cell type(s) present in a biological sample and for diagnosis of diseases and conditions which include, but are not limited to, infertility, and/or other reproductive diseases and/or disorders. Similarly, polypeptides and antibodies directed to these polypeptides are useful in providing immunological probes for differential identification of the tissue(s) or cell type(s). For a number of disorders of the above tissues or cells, particularly of the male and female reproductive systems, expression of this gene at significantly higher or lower levels may be routinely detected in certain tissues or cell types (e.g., testes, and cancerous and wounded tissues) or bodily fluids (e.g. seminal fluid, lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 196 as residues: Lys-35 to Asp-40, Pro-75 to Asn-84, Lys-114 to Arg-129, Arg-138 to Ser-143, Ser-154 to Asn-160, Val-224 to Asn-231, Arg-238 to Asp-243, Asp-276 to Asn-291, Lys-324 to Asp-338. Polynucleotides encoding said polypeptides are also encompassed by the invention.

The tissue distribution in testes combined with the homology to the human, porcine, and mouse zona pellucida protein Sp 38 indicates that polynucleotides and polypeptides corresponding to this gene are useful for the production of a contraceptive vaccine. Alternatively, the protein may show utility in the diagnosis, treatment, and/or prevention of a variety of reproductive disorders within both the male and female reproductive systems. This gene product is also useful in assays designed to identify binding agents, as such agents (antagonists) are useful as male contraceptive agents. Similarly, the protein is believed to be useful in the treatment and/or diagnosis of testicular cancer. The testes are also a site of active gene expression of transcripts that is expressed, particularly at low levels, in other tissues of the body. Therefore, this gene product may be expressed in other specific tissues or organs where it may play related functional roles in other processes, such as hematopoiesis, inflammation, bone formation, and kidney function, to name a few possible target indications.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 64

When tested against U937 cell lines, supernatants removed from cells containing this gene activated the GAS (gamma activating sequence) promoter element. Thus, it is likely that this gene activates myeloid, and to a lesser extent, other cells and tissue cell types, through the JAK-STAT signal transduction pathway. GAS is a promoter element found upstream of many genes which are involved in the Jak-STAT pathway. The Jak-STAT pathway is a large, signal transduction pathway involved in the differentiation and proliferation of cells. Therefore, activation of the Jak-STAT pathway, reflected by the binding of the GAS element, can be used to indicate proteins involved in the proliferation and differentiation of cells.

Translated products of this gene share homology with a human B-cell growth factor molecule (see GenBank Accession AAB02649; all references available through this accession are hereby incorporated herein by reference; for example Sharma S., et al., Science 235 (4795), 1489-1492 (1987)). Based on sequence similarity, translation products of this gene are expected to share at least some biological activities with growth factor molecules, more preferably with B-cell growth factor molecules.

Preferred polypeptides of the invention comprise, or alternatively consist of, an amino acid sequence selected from the group: KNNWWQGVVV LACNPSTLGDRGSWIT (SEQ ID NO: 438), SCLGLPKCWDYRQEPPHPATSYFL (SEQ ID NO: 440), and GQEFETRLTNIVKLRLY (SEQ ID NO: 439). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

This gene is expressed primarily an apoptotic T-cell library, and to a lesser extent, in whole embryo.

Polynucleotides and polypeptides of the invention are useful as reagents for differential identification of the tissue(s) or cell type(s) present in a biological sample and for diagnosis of diseases and conditions which include, but are not limited to, immune, hematopoietic, and developmental diseases and/or disorders, particularly disorders related to aberrant cell death regulation. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., immune, hematopoietic, developmental, reproductive, apoptotic cells, and cancerous and healing tissue or cells) or bodily fluids (e.g., serum, lymph, amniotic fluid, plasma, urine, synovial fluid and spinal fluid, and/or lymph) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 197 as residues: Met-1 to Ala-6, Gly-51 to Gly-71. Polynucleotides encoding said polypeptides are also encompassed by the invention.

The tissue distribution in apoptotic T-cells indicates polynucleotides and polypeptides corresponding to this gene are useful for the diagnosis and treatment of a variety of immune system disorders. Representative uses are described in the "Immune Activity" and "Infectious Disease" sections below, in Example 11, 13, 14, 16, 18, 19, 20, 32, 33, 34, 53, and 58, and elsewhere herein. Briefly, the expression of this gene product indicates a role in regulating the proliferation; survival; differentiation; and/or activation of hematopoietic cell lineages, including blood stem cells. Involvement in the regulation of cytokine production, antigen presentation, or other processes suggests a usefulness in the treatment of cancer (e.g. by boosting immune responses). Expression in cells of lymphoid origin, the natural gene product would be involved in immune functions. Therefore it is also useful as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersensitivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus erythematosis, drug induced hemolytic anemia, rheumatoid arthritis, Sjogren's disease, and scleroderma.

Moreover, the protein may represent a secreted factor that influences the differentiation or behavior of other blood cells, or that recruits hematopoietic cells to sites of injury. Thus, this gene product is thought to be useful in the expansion of stem cells and committed progenitors of various blood lineages, and in the differentiation and/or proliferation of various cell types. The protein can also be used to gain new insight into the regulation of cellular growth and proliferation.

Furthermore, the protein may also be used to determine biological activity, raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 65

The translation product of this gene shares sequence homology with a 50 kDa glycoprotein of the human erythrocyte membrane associated blood-group antigen which is thought to have a transport or channel function in the erythrocyte membrane (See, e.g., GenBank Accessions HSEPMG50, AAC04247, AAD54392, and CAA45883; all references available through this accession are hereby incorporated herein by reference, for example Huang, C.H., J. Biol. Chem. 273 (4), 2207-2213 (1998)).

When tested against Jurkat cell lines, supernatants removed from cells containing this gene activated the GAS (gamma activating sequence) promoter element. Thus, it is likely that this gene activates T-cells, and to a lesser extent, other cells and tissue cell types, through the JAK-STAT signal transduction pathway. GAS is a promoter element found upstream of many genes which are involved in the Jak-STAT pathway. The Jak-STAT pathway is a large, signal transduction pathway involved in the differentiation and proliferation of cells. Therefore, activation of the Jak-STAT pathway, reflected by the binding of the GAS element, can be used to indicate proteins involved in the proliferation and differentiation of cells.

The translation product of this gene has been determined to contain two transmembrane domains located at amino acid positions 95-124, and 1-27 of the amino acid sequence referenced in Table 1A for this gene. Therefore, this protein may share structural characteristics to Type IIIa membrane protein. Based on the sequence similarity to the human erythrocyte membrane associated blood-group antigen, and the structural similarity to type IIIa membrane proteins, the translation product of this gene is expected to share at least some biological activities with such proteins. Such activities are known in the art, some of which are described elsewhere herein.

In another embodiment, polypeptides comprising the amino acid sequence of the open reading frame upstream of the predicted signal peptide are contemplated by the present invention. Specifically, polypeptides of the invention comprise, or alternatively consist of, an amino acid sequence selected from the group:

PAKGEGCRRLHDHPHIWRLLWAHSDPD-PLPTQPRAEQGETEFCVPVGPLCHDWH-PLPVDVLAQLQLSHILP WGQPAPSRHQHLLLLGSL-RAYLGGNIQCPAKKGKLDMVHIQNATLAGGVAVGTA-AEMMLMPYGALIIGF VCGIISTLGFVYLTPFLESRL-HIQDTCGINNLHGIPGIIGGIVGAVTAA-SASLEVYGKEGLVHSFDFQGFNGDW TARTQGKF-QIYGLLVTLAMALMGGIIVGLILRLPFWGQPSDENCF-EDAVYWEMPEGNSTVYIPEDPTFKPSG PSVPSVPM-VSPLPMAS SVPLVP (SEQ ID NO: 441) and MTFFQVTL-FAVNEFILLNLLKVKDAGGSMTIHTF-GAYFGLTVTRILYRRNLEQSKERQNSVYQSDLFAMIG-TLFLWMYWPSFNSAISYHGDSQHRAAIN-TYCSLAACVLTSVAISSALHKKGKLDM-VHIQNATLAGGVAVGT AAE (SEQ ID NO: 442). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

The gene encoding the disclosed cDNA is believed to reside on chromosome 18. Accordingly, polynucleotides related to this invention are useful as a marker in linkage analysis for chromosome 18.

This gene is expressed in in tonsils and to a lesser extent in the larynx, kidney medulla, epithelial cells, keratinocytes, and cells involved in hematopoiesis, especially neutrophils.

Polynucleotides and polypeptides of the invention are useful as reagents for differential identification of the tissue(s) or cell type(s) present in a biological sample and for diagnosis of diseases and conditions which include, but are not limited to, hematopoietic diseases and/or disorders, in addition to, the proliferation and/or differentiation of integumentary cells. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., haematopoetic, integumentary, and cancerous and wounded tissues) or bodily fluids (e.g., serum, plasma, urine, synovial fluid and spinal fluid, lymph) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 198 as residues: Gly-85 to Lys-94, Gln-125 to Cys-131, Glu-151 to Gly-159. Polynucleotides encoding said polypeptides are also encompassed by the invention.

The tissue distribution in tonsils, combined with the homology to a 50 kDa glycoprotein of the human erythrocyte membrane protein indicates polynucleotides and polypeptides corresponding to this gene are useful for the treatment and diagnosis of hematopoietic related disorders such as anemia, pancytopenia, leukopenia, thrombocytopenia or leukemia since stromal cells are important in the production of cells of hematopoietic lineages. Representative uses are described in the "Immune Activity" and "Infectious Disease" sections below, in Example 11, 13, 14, 16, 18, 19, 20, 32, 33, 34, 53, and 58, and elsewhere herein. Briefly, the uses include bone marrow cell ex-vivo culture, bone marrow transplantation, bone marrow reconstitution, radiotherapy or chemotherapy of neoplasia.

The gene product may also be involved in lymphopoiesis, therefore, it can be used in immune disorders such as infection, inflammation, allergy, immunodeficiency etc. In addition, this gene product may have commercial utility in the expansion of stem cells and committed progenitors of various blood lineages, and in the differentiation and/or proliferation of various cell types.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 66

In a preferred embodiment, polypeptides comprising the amino acid sequence of the open reading frame upstream of the predicted signal peptide are contemplated by the present invention. Specifically, polypeptides of the invention comprise, or alternatively consist of, the following amino acid sequence: PRVRTRAPVVPPA GHRALSPAGVLLAV-PAMLSLDFLDDVRRMNKRQVSLSVLFF-SWLFLSLRGCCCGARRTPGFWCEGLSW SD TRVIR-FLWRLWPEAALSASLFLTPN (SEQ ID NO: 443). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding this polypeptide are encompassed by the invention. Antibodies that bind polypeptides of the invention are also encompassed by the invention. Polynucleotides encoding said polypeptides are also encompassed by the invention.

This gene is expressed in hematopoietic tissues, especially helper T-cells and anergic T-cells.

Polynucleotides and polypeptides of the invention are useful as reagents for differential identification of the tissue(s) or cell type(s) present in a biological sample and for diagnosis of diseases and conditions which include, but are not limited to, tuberculosis, AIDS, and other immune diseases and/or disorders, particularly infections and/or malignancies. Similarly, polypeptides and antibodies directed to these polypeptides are useful in providing immunological probes for differential identification of the tissue(s) or cell type(s). For a number of disorders of the above tissues or cells, particularly of the immune system expression of this gene at significantly higher or lower levels may be routinely detected in certain tissues or cell types (e.g., haematopoeitic, immune, and cancerous, and/or wounded tissues) or bodily fluids (e.g., serum, plasma, urine, synovial fluid and spinal fluid, and/or lymph) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 199 as residues: Asp-9 to Gln-17. Polynucleotides encoding said polypeptides are also encompassed by the invention.

The tissue distribution in immune cells and tissues indicates polynucleotides and polypeptides corresponding to this gene are useful for the diagnosis and treatment of a variety of immune system disorders. Representative uses are described in the "Immune Activity" and "Infectious Disease" sections below, in Example 11, 13, 14, 16, 18, 19, 20, 32, 33, 34, 53, and 58, and elsewhere herein. Briefly, the expression of this gene product indicates a role in regulating the proliferation; survival; differentiation; and/or activation of hematopoietic cell lineages, including blood stem cells. Involvement in the regulation of cytokine production, antigen presentation, or other processes suggests a usefulness in the treatment of cancer (e.g. by boosting immune responses). Expression in cells of lymphoid origin, the natural gene product would be involved in immune functions. Therefore it is also useful as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersensitivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus erythematosis, drug induced hemolytic anemia, rheumatoid arthritis, Sjogren's disease, and scleroderma.

Moreover, the protein may represent a secreted factor that influences the differentiation or behavior of other blood cells, or that recruits hematopoietic cells to sites of injury. Thus, this gene product is thought to be useful in the expansion of stem cells and committed progenitors of various blood lineages, and in the differentiation and/or proliferation of various cell types.

Furthermore, the protein may also be used to determine biological activity, raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 67

The polypeptide of this gene has been determined to have a transmembrane domain at about amino acid position 15-34 of the amino acid sequence referenced in Table 1A for this gene. Moreover, a cytoplasmic tail encompassing amino acids 1-14 of this protein has also been determined. Based upon these characteristics, it is believed that the protein product of this gene shares structural features to type II membrane proteins. Translated products of this gene share homology with polypeptides encoded by human herpes and papilloma viruses (see Genbank Accessions CAA58337 and CAA46991; all references available through these accessions are hereby incorporated herein by reference; for example, Gompels,U. A., et al., Virology 209 (1), 29-51 (1995) and Kahn,T., et al., Mol. Carcinog. 6 (2), 88-99 (1992)).

In specific embodiments, polypeptides of the invention comprise, or alternatively consist of, the following amino acid sequence: MCVYIYVYTC MCVYIYVYICICVYIH-VYTCICVYIHVYTCVCVYIYVYTCM-CVYICIYVYIYICVCVSVYIYNRIIYILLALSL (SEQ ID NO: 444). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding this polypeptide are encompassed by the invention. Antibodies that bind polypeptides of the invention are also encompassed by the invention. Polynucleotides encoding this polypeptide are also provided.

This gene is expressed in the fetal liver/spleen, human brain, and retina.

Polynucleotides and polypeptides of the invention are useful as reagents for differential identification of the tissue(s) or cell type(s) present in a biological sample and for diagnosis of diseases and conditions which include, but are not limited to, immune, neurologic, and visual diseases and/or disorders, particularly retinoblastoma as well as other diseases or disorders involving the retina and/or brain. Similarly, polypeptides and antibodies directed to these polypeptides are useful in providing immunological probes for differential identification of the tissue(s) or cell type(s). For a number of disorders of the above tissues or cells, particularly of the neurologic system and in eye development, expression of this gene at significantly higher or lower levels may be routinely detected in certain tissues or cell types (e.g., immune, visual, retinal, neural, cancerous, and/or wounded tissues) or bodily fluids (e.g., serum, plasma, aqueous humor, vitreous humor, urine, amniotic fluid, synovial fluid and spinal fluid, vitreous and aqueous humors) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 200 as residues: Glu-48 to Thr-54. Polynucleotides encoding said polypeptides are also encompassed by the invention.

The tissue distribution in fetal liver/spleen indicates polynucleotides and polypeptides corresponding to this gene are useful for the treatment and diagnosis of hematopoietic related disorders such as anemia, pancytopenia, leukopenia, thrombocytopenia or leukemia since stromal cells are important in the production of cells of hematopoietic lineages. Representative uses are described in the "Immune Activity" and "Infectious Disease" sections below, in Example 11, 13, 14, 16, 18, 19, 20, 32, 33, 34, 53, and 58, and elsewhere herein. Briefly, the uses include bone marrow cell ex-vivo culture, bone marrow transplantation, bone marrow reconstitution, radiotherapy or chemotherapy of neoplasia.

The gene product may also be involved in lymphopoiesis, therefore, it can be used in immune disorders such as infection, inflammation, allergy, immunodeficiency etc. In addition, this gene product may have commercial utility in the expansion of stem cells and committed progenitors of various blood lineages, and in the differentiation and/or proliferation of various cell types. Alternatively, representative uses are described in the "Regeneration" and "Hyperproliferative Disorders" sections below, in Example 11, 15, 39, 41, 42, 43, and 51, and elsewhere herein. Briefly, the uses include, but are not limited to the detection, treatment, and/or prevention of Alzheimer's Disease, Parkinson's Disease, Huntington's Disease, Tourette Syndrome, schizophrenia, mania, dementia, paranoia, obsessive compulsive disorder, panic disorder, learning disabilities, ALS, psychoses, autism, and altered behaviors, including disorders in feeding, sleep patterns, balance, and perception. In addition, the gene or gene product may also play a role in the treatment and/or detection of developmental disorders associated with the developing embryo, sexually-linked disorders, or disorders of the cardiovascular system.

Alternatively, expression of this gene with in the retina may suggest gene is useful for the diagnosis, treatment, and/or prevention of a variety of eye disorders and/or conditions.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 68

The translation product of this gene shares sequence homology with the glutamate-binding subunit of an N-methyl-D-asparate receptor complex. The amino acids L-glutamic and L-aspartic acids form the most widespread excitatory transmitter network in mammalian brain. The excitation produced by L-glutamic acid is important in the early development of the nervous system, synaptic plasticity and memory formation, seizures and neuronal degeneration. The receptors activated by L-glutamic acid are a target for therapeutic intervention in neurodegenerative diseases, brain ischaemia and epilepsy. As such, the protein product of this gene may also play a role in the regulation of the nitrous oxide synthase gene which is known to be a vital link in various signal transduction pathways within the brain as well as other tissues (See GenBank No. bbs|61979 and Medline Article No. 92049755).

Moreover, the translation product of this gene was also shown to have homology to a neural membrane protein 35 (See Genbank Accession No. gb|AAC32463.1| (AF044201); all references available through this accession are hereby incorporated herein by reference; for example, Mol. Cell. Neurosci. 11 (5), 260-273 (1998)).

The polypeptide of this gene has been determined to have two transmembrane domains at about amino acid position 42-73, and 75-94 of the amino acid sequence referenced in Table 1A for this gene. Based upon these characteristics, it is believed that the protein product of this gene shares structural features to Ma membrane proteins.

When tested against U937 and Jurkat cell lines, supernatants removed from cells containing this gene activated the GAS (gamma activating sequence) promoter element. Thus, it is likely that this gene activates myeloid and T-cells, and to a lesser extent, other cells and tissue cell types, through the JAK-STAT signal transduction pathway. GAS is a promoter element found upstream of many genes which are involved in the Jak-STAT pathway. The Jak-STAT pathway is a large, signal transduction pathway involved in the differentiation and proliferation of cells. Therefore, activation of the Jak-STAT pathway, reflected by the binding of the GAS element, can be used to indicate proteins involved in the proliferation and differentiation of cells.

Preferred polypeptides of the invention comprise, or alternatively consist of, an amino acid sequence selected from the group: HASAWNLILLTVFTLS (SEQ ID NO: 445), VYAALGAGVFTLFLALDTQLLMGN (SEQ ID NO: 446), EEYIFGA LNIYLDIIYIF (SEQ ID NO: 447), and/or WNLILLTVFTLSMAYLTGMLSSYYNT (SEQ ID NO: 448). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

In another embodiment, polypeptides comprising the amino acid sequence of the open reading frame upstream of the predicted signal peptide are contemplated by the present invention. Specifically, polypeptides of the invention comprise, or alternatively consist of, the following amino acid sequence: MAYLTGML SSYYNTTSVLLCLGITALVCLS-VTVFSFQTKFDFTSCQGVLFVLLMTLFF-SGLILAILLPFQYVPWLHAVYAA LGAGVFTLFLA-LDTQLLMGNRRHSLSPEEYIFGALNIYLDIIYIFTFFL-QLFGTNRE (SEQ ID NO: 449). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

This gene is expressed in the brain and to a lesser extent in dendritic cells and in the kidney cortex.

Polynucleotides and polypeptides of the invention are useful as reagents for differential identification of the tissue(s) or cell type(s) present in a biological sample and for diagnosis of diseases and conditions which include, but are not limited to, schizophrenia, epilepsy, brain ischaemia, and neurodegenerative diseases. Similarly, polypeptides and antibodies directed to these polypeptides are useful in providing immunological probes for differential identification of the tissue(s) or cell type(s). For a number of disorders of the above tissues or cells, particularly of the nervous system expression of this gene at significantly higher or lower levels may be routinely detected in certain tissues or cell types (e.g., neural, cancerous and wounded tissues) or bodily fluids (e.g., serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 201 as residues: Ala-12 to Glu-27, Pro-35 to Ser-43, Pro-70 to Gly-79, Ser-92 to Val-98, Pro-166 to Leu-175, Ser-234 to Thr-246. Polynucleotides encoding said polypeptides are also encompassed by the invention.

The tissue distribution combined with the homology to a known N-methyl-D-asparate receptor indicates polynucleotides and polypeptides corresponding to this gene are useful for the detection, treatment, and/or prevention of neurodegenerative disease states, behavioral disorders, or inflammatory conditions. Representative uses are described in the "Regeneration" and "Hyperproliferative Disorders" sections below, in Example 11, 15, 39, 41, 42, 43, and 51, and elsewhere herein. Briefly, the uses include, but are not limited to the detection, treatment, and/or prevention of Alzheimer's Disease, Parkinson's Disease, Huntington's Disease, Tourette Syndrome, meningitis, encephalitis, demyelinating diseases, peripheral neuropathies, neoplasia, trauma, congenital malformations, spinal cord injuries, ischemia and infarction, aneurysms, hemorrhages, schizophrenia, mania, dementia, paranoia, obsessive compulsive disorder, depression, panic disorder, learning disabilities, ALS, psychoses, autism, and altered behaviors, including disorders in feeding, sleep patterns, balance, and perception. In addition, elevated expression of this gene product in regions of the brain indicates it plays a role in normal neural function. Potentially, this gene product is involved in synapse formation, neurotransmission, learning, cognition, homeostasis, or neuronal differentiation or survival. This protein may play a role in the regulation of cellular division, and may show utility in the diagnosis, treatment, and/or prevention of developmental diseases and disorders. The protein can also be used to gain new insight into the regulation of cellular growth and proliferation.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 69

The polypeptide of this gene has been determined to have a transmembrane domain at about amino acid position 37-62 of the amino acid sequence referenced in Table 1A for this gene. Based upon these characteristics, it is believed that the protein product of this gene shares structural features to Type Ia membrane proteins.

The translation product of this gene was also determined to have a conserved peroxidase-I domain (PROSITE entry PDOC00394; Swiss Institute of Bioinformatics) located at about amino acid position 15-25 of the amino acid sequence referenced in Table 1A for this gene.

Preferred polypeptides of the invention comprise, of alternatively consist of, the following amino acid sequence: TLSLLVSLHTV (SEQ ID NO: 450). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

Peroxidases are heme-binding enzymes that carry out a variety of biosynthetic and degradative functions using hydrogen peroxide as the electron acceptor. Peroxidases are widely distributed throughout bacteria, fungi, plants, and vertebrates. In peroxidases the heme prosthetic group is protoporphyrin IX and the fifth ligand of the heme iron is a histidine (known as the proximal histidine). An other histidine residue (the distal histidine) serves as an acid-base catalyst in the reaction between hydrogen peroxide and the enzyme. The regions around these two active site residues are more or less conserved in a majority of peroxidases (see Dawson J.H., Science 240:433-439 (1988); Kimura S., Ikeda-Saito M., Proteins 3:113-120 (1988); Henrissat B., et al., Proteins 8:251-257 (1990); and Welinder K.G., Biochem. Biophys. Acta 1080:215-220 (1991). All references are hereby incorporated herein.)

This gene is expressed in the brain.

Polynucleotides and polypeptides of the invention are useful as reagents for differential identification of the tissue(s) or cell type(s) present in a biological sample and for diagnosis of diseases and conditions which include, but are not limited to, neurological diseases and disorders, a non-limiting example of which includes, epilepsy. Similarly, polypeptides and antibodies directed to these polypeptides are useful in providing immunological probes for differential identification of the tissue(s) or cell type(s). For a number of disorders of the above tissues or cells, particularly of the nervous system expression of this gene at significantly higher or lower levels may be routinely detected in certain tissues or cell types (e.g., neural, cancerous, and/or wounded tissues) or bodily fluids (e.g., serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in brain tissue indicates polynucleotides and polypeptides corresponding to this gene are useful for the detection, treatment, and/or prevention of neurodegenerative disease states, behavioral disorders, or inflammatory conditions. Representative uses are described in the "Regeneration" and "Hyperproliferative Disorders" sections below, in Example 11, 15, 39, 41, 42, 43, and 51, and elsewhere herein. Briefly, the uses include, but are not limited to the detection, treatment, and/or prevention of Alzheimer's Disease, Parkinson's Disease, Huntington's Disease, Tourette Syndrome, meningitis, encephalitis, demyelinating diseases, peripheral neuropathies, neoplasia, trauma, congenital malformations, spinal cord injuries, ischemia and infarction, aneurysms, hemorrhages, schizophrenia, mania, dementia, paranoia, obsessive compulsive disorder, depression, panic disorder, learning disabilities, ALS, psychoses, autism, and altered behaviors, including disorders in feeding, sleep patterns, balance, and perception. In addition, elevated expression of this gene product in regions of the brain indicates it plays a role in normal neural function. Potentially, this gene product is involved in synapse formation, neurotransmission, learning, cognition, homeostasis, or neuronal differentiation or survival.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 70

When tested against Jurkat cell lines, supernatants removed from cells containing this gene activated the GAS (gamma activating sequence) promoter element. Thus, it is likely that this gene activates T-cells, and to a lesser extent, other cells and tissue cell-types, through the JAK-STAT signal transduction pathway. GAS is a promoter element found upstream of many genes which are involved in the Jak-STAT pathway. The Jak-STAT pathway is a large, signal transduction pathway involved in the differentiation and proliferation of cells. Therefore, activation of the Jak-STAT pathway, reflected by the binding of the GAS element, can be used to indicate proteins involved in the proliferation and differentiation of cells.

In additional embodiments, polypeptides of the invention comprise, or alternatively consist of, an amino acid sequence selected from the group:

MSSSGTSDASPSGSPVLASYKPAPPKDKLPETPRRRMKKSLSAPLHPEFEEVYRFGAESRKLLLREPVDAMP DPTPFLLARESAEVHLIKERPLVIPPIASDRSGEQHSPAREKPHKAHVGVAHRIHHATPPQPARGEDPGGRPG ERRQGGEEALRDGQNCVKPAVPHPALSMHCEHHWEISATPFLFNPMHAKHFSHLPTHSPSASLALFFTPKYDRVPAAEYVFPNCCGQTPVCRIACF (SEQ ID NO: 451); MSSSGTS DASPSGSPVLASYKPAPPKDKLPETPRRRMKKSLSAPLHPEFEEVYRFGAESRKLLLREPVDAMPDPTPFLL ARESAE (SEQ ID NO: 452); VHLIKERPLVIPPI ASDRSGEQHSPAREKPHKAHVGVAHRIHHATPPQPARGEDPGGRPGERR (SEQ ID NO: 453); QGGEEALRDGQNCVKPAVPHPALSMHCEHHWEISATPF LFNPMHAKHFSHLPTHSPSASLALFFTPKYDRVPAAEYVFPNCCGQTPVCRIACF (SEQ ID NO: 454); KRASQPPCTRNLKRSTDSGQRAGNSFCGNQWMLCPTPPHFCWLGSPPRSTSSKRGPSSS (SEQ ID NO: 455); and PPSPPTEAASSTARPAKSRTRPTSGWHIGSTTPPRRSQPEVKTLAVDQVNGGKVVRKHSGTDRTV (SEQ ID NO: 456). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

The gene encoding the disclosed cDNA is believed to reside on chromosome 12. Accordingly, polynucleotides related to this invention are useful as a marker in linkage analysis for chromosome 12.

This gene is expressed in Endometrial Tumor, fetal liver, Hypothalamus, Larynx carcinoma III, Prostate Cancer.

Polynucleotides and polypeptides of the invention are useful as reagents for differential identification of the tissue(s) or cell type(s) present in a biological sample and for diagnosis of diseases and conditions which include, but are not limited to, endometrial tumor, larynx carcinoma III, prostate cancer, in addition to other proliferative diseases and/or disorders. Similarly, polypeptides and antibodies directed to these polypeptides are useful in providing immunological probes for differential identification of the tissue(s) or cell type(s). For a number of disorders of the above tissues or cells, particularly of the reproductive, hepatic, and pulmonary systems, expression of this gene at significantly higher or lower levels may be routinely detected in certain tissues or cell types (e.g., hepatic, developmental, differentiating, proliferative, and cancerous, and/or other tissues) or bodily fluids (e.g., serum, plasma, urine, synovial fluid and spinal fluid, pulmonary surfactant) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 203 as residues: Ala-62 to Tyr-71. Polynucleotides encoding said polypeptides are also encompassed by the invention.

The tissue distribution in tumors of endometrium, larynx, and prostate origins, combined with the detected GAS biological activity, indicates that polynucleotides and polypeptides corresponding to this gene are useful for diagnosis and intervention of these tumors, in addition to other tumors where expression has been indicated. The expression within cellular sources marked by proliferating cells indicates this protein may play a role in the regulation of cellular division, and may show utility in the diagnosis, treatment, and/or prevention of developmental diseases and disorders, including cancer, and other proliferative conditions. Representative uses are described in the "Hyperproliferative Disorders" and "Regeneration" sections below and elsewhere herein. Briefly, developmental tissues rely on decisions involving cell differentiation and/or apoptosis in pattern formation. Alternatively, the tissue distribution within liver tissue indicates that polynucleotides and polypeptides corresponding to this gene are useful for the detection and treatment of liver disorders and cancers (e.g. hepatoblastoma, jaundice, hepatitis, liver metabolic diseases and conditions that are attributable to the differentiation of hepatocyte progenitor cells). In addition the expression in fetus would suggest a useful role for the protein product in developmental abnormalities, fetal deficiencies, pre-natal disorders and various would-healing models and/or tissue trauma.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 71

In a preferred embodiment, polypeptides of the invention comprise, or alternatively consist of, an amino acid sequence selected from the group:

MWNPNAGQPGPNPYPPNIGCPGGSNPAH-PPPINPPFPPGPCPPPPGAPHGNPAFP-PGGPPHPVPQPGYPGCQP LGPYPPPYPPPAPGIPPVN-PLAPGMVGPAVIVDKKMQKKMKKAHKKMHKHQK-HHKYHKHGKHSSSSSSSS SSDSD (SEQ ID NO: 457); RVGPDAWADAWEQAQAAVERLEDTPKH-VESQCRAARAKSISPQYWV PWRFQSCPPTTY (SEQ ID NO: 458); STLSPRPLSSSPRSSPWQSSFPPRWA PSS-CATARVSRMPTVGSLPSSIPTACPWNP-SCESLGSWHGWTSSDSRQEDAEENEESS (SEQ ID NO: 459); MPGSQGQIHIPPILGALEVPILPTHHL-LIHPFPQAPV LLPQELPMAIQLSPQVGPLILCH-SQGIQDANRWVPTLLHTHRLPLESLL (SEQ ID NO: 460); and/or MASIPPLPPPLPAVILTEYRPWTLPSS-LTSSALPSSFRCHVVLGECSPCAPHPLPXPEPHPAVEP (SEQ ID NO: 461). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

This gene is expressed in bone marrow and primary dendritic cells, in addition to macrophages.

Polynucleotides and polypeptides of the invention are useful as reagents for differential identification of the tissue(s) or cell type(s) present in a biological sample and for diagnosis of immune and haematopoeitic diseases and/or disorders. Similarly, polypeptides and antibodies directed to these polypeptides are useful in providing immunological probes for differential identification of the tissue(s) or cell type(s). For a number of disorders of the above tissues or cells, particularly of the immune, expression of this gene at significantly higher or lower levels may be routinely detected in certain tissues or cell types (e.g., haematopoeitic, immune, and cancerous, and/or other tissues) or bodily fluids (e.g., serum, plasma, urine, synovial fluid and spinal fluid, and/or lymph) or another tissue or cell sample taken from an individual having such a disorder, relative to the standard gene expression level, i.e., the expression level in healthy tissue or bodily fluid from an individual not having the disorder.

The tissue distribution in bone marrow indicates polynucleotides and polypeptides corresponding to this gene are useful for the treatment and diagnosis of hematopoietic related disorders such as anemia, pancytopenia, leukopenia, thrombocytopenia or leukemia since stromal cells are important in the production of cells of hematopoietic lineages. Representative uses are described in the "Immune Activity" and "Infectious Disease" sections below, in Example 11, 13, 14, 16, 18, 19, 20, 32, 33, 34, 53, and 58, and elsewhere herein. Briefly, the uses include bone marrow cell ex-vivo culture, bone marrow transplantation, bone marrow reconstitution, radiotherapy or chemotherapy of neoplasia.

The gene product may also be involved in lymphopoiesis, therefore, it can be used in immune disorders such as infection, inflammation, allergy, immunodeficiency etc. In addition, this gene product may have commercial utility in the expansion of stem cells and committed progenitors of various blood lineages, and in the differentiation and/or proliferation of various cell types.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 72

The translated product of this gene is likely a Type Ia membrane protein containing a transmembrane domain at about amino acid residues 125 through about 141.

In another embodiment, polypeptides of the invention comprise, or alternatively consist of, an amino acid sequence selected from the group:

PRHTYWGIWLVPAAMASPHSHPAQGV-LQPPGPQPRWEDRVALGTRGRSPGAYLT-ESAPQQASTTPGPPTC HGKVGSEWAWLGAAPG-PLPTHPSHYAIRVPSNICSCPGASSAPALRGVVRQPPG-PQNPRQGGRRGTRASPV GSLFCV (SEQ ID NO: 462); MFAVLPAVEGRATPHQDRTCYPSRSRP-WPSQPSPRGSMPVPRPGAARGQLDGH-VQGQGWALQWGGPPAP AVYRRMALPPRAAG-SYLDRKCPHPLPGARLCPGLPL (SEQ ID NO: 463); VFGAVFLTTPSHDLATPTGASGWCLLPW-PAPTLTLHRG SCSPQAHSLVGRTGWPWGQEG-GAQGLTSLRVLPSRHPLPQGPPHVMAR-LVVNGPGWEQPLAHCPPTHLT MQFEFQATFAPALGPALPQP (SEQ ID NO: 464); HEEP-PAGFGLRSLWRRSPPHEVGARLPNGAFG-FSVRCLLCFPPWRAEPPHIRIGRATPPG-PGPGPASPALEAR CLCQGQGQPEGSWMATCRVKAGPCS-GAGRQPQQFTDAWLFLPEQPAATWTGNV-LIPSLGPGSALAFLCEP LLSLCCLGTPDRGVRVCPS-VTFYSPRVEERKRGKSKGVQTPPQ (SEQ ID NO: 465); MATCRVKAGPCSGAGRQPQQ FTDAWLFLPEQ-PAATWTGNVLIPSLGPGSALAFLCE-PLLSLCCLGTPDRGVRVCPSVTFYSPRVEERKRGKS KGVQTPPQ (SEQ ID NO: 466); MKWFSTQPLWLNTK QRSHRRGPGPPPAPLSGVLGSRGL-PHHPSQGWGRAGPRAGANVAWNSNCIVR-WVGGQWARGCSQPGPFT TNLAMTCGGPWGSG-CLLGSTLSEVSPWAPPSCPQGHPVLPTRLWAWGLQD-PLCRVRVGAGHGSRHQPDA PVGVARSWDGVVRN-TAPKTQNKNTTNGRRSPPPTEVGFEPL-LIFPVSFLQPLVSRKSQTGTHAHHGQESRD STKKG-GVHRGRPGQSLAPGRG (SEQ ID NO: 467); KVTDGHTRTPRSGVPRQHKERRGSQR KARAEPG-PREGMRTFPVQVAAGCSGRKSHAS-VNCWGWRPAPLQGPALTLHVAIQLPS-GCPWPWHRHRAS RAGLAGPGPGPGGVARPILMWGGSALHG-GKHSKHRTLKPKAPLGSLAPTSWG-GDRRHRDLSPKPAGGSSC (SEQ ID NO: 468); and/or MRTFPVQVAAGCSGRKSHASVNCWGWR-PAPLQGPALTLHVAIQLPSGCPWP-WHRHRASRAGLAGPGPGP GGVARPILMWGGSAL-HGGKHSKHRTLKPKAPLGSLAPTSWGGDRRHRDLS-PKPAGGSSC (SEQ ID NO: 469). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

The gene encoding the disclosed cDNA is believed to reside on chromosome 7. Accordingly, polynucleotides related to this invention are useful as a marker in linkage analysis for chromosome 7.

This gene is expressed in healing wound tissues, macrophage-oxLDL, hemangiopericytoma, and CD34+ cells.

Polynucleotides and polypeptides of the invention are useful as reagents for differential identification of the tissue(s) or cell type(s) present in a biological sample and for diagnosis of diseases and conditions which include, but are not limited to, healing wound, and proliferative diseases and/or disorders, particularly soft tissue cancers, such as hemangiopericytoma. Similarly, polypeptides and antibodies directed to these polypeptides are useful in providing immunological probes for differential identification of the tissue(s) or cell type(s). For a number of disorders of the above tissues or cells, particularly of healing wounds, expression of this gene at significantly higher or lower levels may be routinely detected in certain tissues or cell types (e.g., lymph, cancerous, and/or wounded tissues) or bodily fluids (e.g., serum, plasma, urine, synovial fluid and spinal fluid, and/or lymph) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 205 as residues: Met-1 to Gly-6, Arg-23 to Gly-33, Arg-60 to Ala-66, Thr-90 to Gly-103, Glu-105 to Trp-112. Polynucleotides encoding said polypeptides are also encompassed by the invention.

The tissue distribution within healing wounds indicates that polynucleotides and polypeptides corresponding to this gene are useful for the diagnosis and treatment of cancer and other proliferative disorders. Representative uses are described elsewhere herein. Expression within cellular sources marked by proliferating cells indicates that this protein may play a role in the regulation of cellular division. Additionally, the expression in hematopoietic cells and tissues indicates that this protein may play a role in the proliferation, differentiation, and/or survival of hematopoietic cell lineages. In such an event, this gene may be useful in the treatment of lymphoproliferative disorders, and in the maintenance and differentiation of various hematopoietic lineages from early hematopoietic stem and committed progenitor cells. Similarly, embryonic development also involves decisions involving cell differentiation and/or apoptosis in pattern formation. Thus this protein may also be involved in apoptosis or tissue differentiation and could again be useful in cancer therapy.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 73

The translation product of this gene has homology to the Pro-Pol-dUTPase polyprotein of a newly discovered retrovirus. Since this protein also shares homology to the human HERV-L element, and considering that most retroviruses integrate their proviral form into eukaryotic genomes through a homologous recombination mechanism, this gene is useful in providing protection against retroviral infections or could be used in the development of gene therapy applications (See Genebank Accession No. 2065210; all references available through this accession are hereby incorporated by reference herein).

Preferred polypeptides of the invention comprise, or alternatively consist of, an amino acid sequence selected from the group: GLMECLIHRHGSH (SEQ ID NO: 470), and/or STKGMQFILTGITLSGY (SEQ ID NO: 471). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

This gene is expressed in CD34 positive cells.

Polynucleotides and polypeptides of the invention are useful as reagents for differential identification of the tissue(s) or cell type(s) present in a biological sample and for diagnosis of diseases and conditions which include, but are not limited to, immune diseases and/or disorders, particularly viral infections. Similarly, polypeptides and antibodies directed to these polypeptides are useful in providing immunological probes for differential identification of the tissue(s) or cell type(s). For a number of disorders of the above tissues or cells, particularly of the immune, expression of this gene at significantly higher or lower levels may be routinely detected in certain tissues or cell types (e.g., immune, and cancerous, wounded, and/or other tissues) or bodily fluids (e.g., serum, plasma, urine, synovial fluid and spinal fluid, and/or lymph) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 206 as residues: Arg-39 to Thr-49, Leu-52 to Gly-60, Ser-67 to Arg-76, Gln-130 to Phe-137, Ser-139 to His-148. Polynucleotides encoding said polypeptides are also encompassed by the invention.

The tissue distribution in CD34+ immune cells combined with the homology to a retroviral protein indicates that polynucleotides and polypeptides corresponding to this gene are useful for the diagnosis and treatment of a variety of immune system disorders. Expression of this gene product in immune indicates a role in the regulation of the proliferation; survival; differentiation; and/or activation of potentially all hematopoietic cell lineages, including blood stem cells. This gene product may be involved in the regulation of cytokine production, antigen presentation, or other processes that may also suggest a usefulness in the treatment of cancer e.g. by boosting immune responses. Expression in cells of lymphoid origin, the natural gene product may be involved in immune functions. Therefore it may be also used as an agent for immunological disorders including arthritis, asthma, immune deficiency diseases such as AIDS, and leukemia. In addition, this gene product may have commercial utility in the expansion of stem cells and committed progenitors of various blood lineages, and in the differentiation and/or proliferation of various cell types.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 74

The translation product of this gene shares sequence homology with mouse, bovine, and human butyrophilins, which are thought to be important in lactation especially during the latter part of pregnancy. Butyrophilin is a glycoprotein of the immunoglobulin superfamily that is secreted in association with the milk-fat-globule membrane from mammary epithelial cells (See Genbank Accession No.gb|AAB51034.1, and Geneseq Accession No. W97814; all references available through these accessions are hereby incorporated herein by reference; for example, Mamm. Genome 7 (12), 900-905 (1996)). Based on the sequence similarity, the translation product of this gene is expected to share at least some biological activities with glycoproteins. Such activities are known in the art, some of which are described elsewhere herein.

In another embodiment, polypeptides of the invention comprise, or alternatively consist of, an amino acid sequence selected from the group:

PRVRALLFARSLRLCRW-GAKRLGVASTEAQRGVSFKLEEKTAHSS-LALFRDDTGVKYGLVGLEPTKVALN VERFREWAVV-LADTAVTSGRHYWEVTVKRSQQFRIGVADVDMSRD-SCIGVDDRSWVFTMPSASGTPCWP TRKPQLRVLG-SQEVGLLLEYEAQKLSLVDVSQVSV-VHTLQTDFRGPVVPAFALWDGELLTHSGLEVPEGL (SEQ ID NO: 472), and/or MSRDSCIGVDDRSWVFTMP-SASGTPCWPT RKPQLRVLGSQEVGLLLE-YEAQKLSLVDVSQVSVVHTLQTDFRGPV-VPAFALWDGELLTHSGLEVPEGL (SEQ ID NO: 473). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

This gene is expressed in adult heart, LNCAP cell line, OB cell line (HOS fraction), and epididymis, and to a lesser extent in a variety of other cells and tissues.

Polynucleotides and polypeptides of the invention are useful as reagents for differential identification of the tissue(s) or cell type(s) present in a biological sample and for diagnosis of diseases and conditions which include, but are not limited to, coronary disease and heart tumors and reproductive disorders, particularly those of the male reproductive system. Similarly, polypeptides and antibodies directed to these polypeptides are useful in providing immunological probes for differential identification of the tissue(s) or cell type(s). For a number of disorders of the above tissues or cells, particularly those of the heart and reproductive system, expression of this gene at significantly higher or lower levels may be routinely detected in certain tissues or cell types (e.g., cardio-vascular, cardiac, reproductive, and cancerous and wounded tissues) or bodily fluids (e.g., serum, plasma, urine, seminal fluid, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 207 as residues: Gly-30 to Ser-36. Polynucleotides encoding said polypeptides are also encompassed by the invention.

The tissue distribution and homology to butyrophilin indicates that polynucleotides and polypeptides corresponding to this gene are useful for determining the mechanisms underlying mammary-specific gene expression, lactation, and potentially for the production of copious amounts of butyrophilin or heterologous proteins in the milk of transgenic animals. The secreted protein can also be used to determine biological activity, to raise antibodies, as tissue markers, to isolate cognate ligands or receptors, to identify agents that modulate their interactions, and as nutritional supplements. It may also have a very wide range of biological activities. Representative uses are described in the "Chemotaxis" and "Binding Activity" sections below, in Example 11, 12, 13, 14, 15, 16, 18, 19, 20, 32, 33, 34, 53, and 58, and elsewhere herein. Briefly, the protein may possess the following activities: cytokine, cell proliferation/differentiation modulating activity or induction of other cytokines; immunostimulating/immunosuppressant activities (e.g. for treating human immunodeficiency virus infection, cancer, autoimmune diseases and allergy); regulation of hematopoiesis (e.g. for treating anemia or as adjunct to chemotherapy); stimulation or growth of bone, cartilage, tendons, ligaments and/or nerves (e.g. for treating wounds, stimulation of follicle stimulating hormone (for control of fertility); chemotactic and chemokinetic activities (e.g. for treating infections, tumors); hemostatic or thrombolytic activity (e.g. for treating hemophilia, cardiac infarction etc.); anti-inflammatory activity (e.g. for treating septic shock, Crohn's disease); as antimicrobials; for treating psoriasis or other hyperproliferative diseases; for regulation of metabolism, and behavior. Also contemplated is the use of the corresponding nucleic acid in gene therapy procedures.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 75

The translation product of this gene shares sequence homology with angiopoietin-2 which is thought to be important in regulation of angiogenesis through the Tie2, or other receptor tyrosine kinase (See Genbank Accession Nos. gb|AAC97965.1| (AF110520), and gb|AAB63189.1| (AF004326); in addition to Geneseq Accession No. R94603; all references available through these accessions are hereby incorporated herein by reference; for example, Science 277 (5322), 55-60 (1997)). Based on the sequence similarity, the translation product of this gene is expected to share at least some biological activities with angiogenic and kinase proteins. Such activities are known in the art, some of which are described elsewhere herein.

In another embodiment, polynucleotides of the invention comprise, or alternatively consist of, an amino acid sequence selected from the group:

GCACGAGCGGCACGAGCGGATCCTCACACGACTGTGATCCGATTCTTTCCAGCGGCTTCTGCAACCAA GCGGGTCTTACCCCCGGTCCTCCGCGTCTCCAGTCCTCGCACCTGGAACCCCAACGTCCCGAGAGTCC CCGAATCCCCGCTCCCAGGCTACCTAAGAGGATGAGCGGTGCTCCGACGGCCGGGGCAGCCCTGATGC TCTGCGCCGCCACCGCCGTGCTACTGAGCGCTCAGGGCGGACCCGTGCAGTCCAAGTCGCCGCGCTTT GCGTCCTGGGACGAGATGAATGTCCTGGCGCACGGACTCCTGCAGCTCGGCCAGGGGCTGCGCGAACA CGCGGAGCGCACCCGCAGTCAGCTGAGCGCGCTGGAGCGGCGCCTGAGCGCGTGCGGGTCCGCCTGTC AGGGAACCGAGGGGTCCACCGACCTCCCGTTAGCCCCTGAGAGCCGGGTGGACCCTGAGGTCCTTCACAGCCTGCAGACACAACTCAAGGCTCAGAACAGCAGGATCCAGCAACTCTTCCACAAGGTGGCCCAGCAGCAGCGGCACCTGGAGAAGCAGCACCTGCGAATTCAGC ATCTGCAAAGCCAGTTTGGCCTCCTGGAC CACAAGCACCTAGACCATGAGGTGGCCAAGCCTGCCCGAAGAAAGAGGCTGCCCGAGATGGCCCAGC CAGTTGACCCGGCTCACAATGTCAGCCGCCTGCACCGGCTGCCCAGGGATTGCCAGGAGCTGTTCCAG GTTGGGGAGAGGCAGAGTGGACTATTTGAAATCCAGCCTCAGGGGTCTCCGCCATTTTTGGTGAACTG CAAGATGACCTCAGATGGAGGCTGGACAGTAATTCAGAGGCGCCACGATGGCTCAGTGGACTTCAACC GGCCCTGGGAAGCCTACAAGGCGGGGTTTGGGGATCCCCACGGCGAGTTCTGGCTGGGTCTGGAGAAG GTGCATAGCATCACGGGGGACCGCAACAGCCGCCTGGCCGTGCAGCTGCGGGACTGGGATGGCAACG CCGAGTTGCTGCAGTTCTCCGTGCACCTGGGTGGCGAGGACACGGCCTATAGCCTGCAGCTCACTGCA CCCGTGGCCGGCCAGCTGGGCGCCACCACCGTCCCACCCAGCGGCCTCTCCGTACCCTTCTCCACTTGG GACCAGGATCACGACCTCCGCAGGGACAAGAACTGCGCCAAGAGCCTCTCTGGAGGCTGGTGGTTTGG CACCTGCAGCCATTCCAACCTCAACGGCCAGTACTTCCGCTCCATCCCACAGCAGCGGCAGAAGCTTA AGAAGGGAATCTTCTGGAAGACCTGGCGGGGCCGCTACTACCCGCTGCAGGCCACCACCATGTTGATC CAGCCCATGGCAGCAGAGGCAGCCTCCTAGCGTCCTGGCTGGGCCTGGTCCCAGGCCCACGAAAGACG GTGACTCTTGGCTCTGCCCGAGGATGTGGCCGTTCCCTGCCTGGGCAGGGGCTCCAAGGAGGGGCCAT CTGGAAACTTGTGGACAGAGAAGAAGACCACGACTGGAGAAGCCCCCTTTCTGAGTGCAGGGGGGCT GCATGCGTTGCCTCCTGAGATCGAGGCTGCAGGATATGCTCAGACTCTAGAGGCGTGGACCAAGGGGC ATGGAGCTTCACTCCTTGCTGGCCAGGGAGTTGGGGACTCAGAGGGACCACTTGGGGCCAGCCAGACT GGCCTCAATGGCGGACTCAGTCACATTGACTGACGGGGACCAGGGCTTGTGTGGGTCGAGAGCGCCCT CATGGTGCTGGTGCTGTTGTGTGTAGGTCCCCTGGGGACACAAGCAGGCGCCAATGGTATCTGGGCGG AGCTCACAGAGTTCTTGGAATAAAAGCAACCTCAGAACAAAAAAAAAAAAAAAAAAAAAAAAAAAAA AAAAAAAAAAAAA (SEQ ID NO:474), and/or ATGAGCGGT GCTCCGACGGCCGGGGCAGCCCTGATGCTCTGCGCCGCCACCGCCGTGCTACTGAGCGCTCAGGGCGG ACCCGTGCAGTCCAAGTCGCCGCGCTTTGCGTCCTGGGACGAGATGAATGTCCTGGCGCACGGACTCC TGCAGCTCGGCCAGGGGCTGCGCGAACACGCGGAGCGCACCCGCAGTCAGCTGAGCGCGCTGGAGCG GCGCCTGAGCGCGTGCGGGTCCGCCTGTCAGGGAACCGAGGGGTCCACCGACCTCCCGTTAGCCCCTG AGAGCCGGGTGGACCCTGAGGTCCTTCACAGCCTGCAGACACAACTCAAGGCTCAGAACAGCAGGAT CCAGCAACTCTTCCACAAGGTGGCCCAGCAGCAGCGGCACCTGGAGAAGCAGCACCTGCGAATTCAGC ATCTGCAAAGCCAGTTTGGCCTCCTGGACCACAAGCACCTAGACCATGAGGTGGCCAAGCCTGCCCGA AGAAAGAGGCTGCCCGAGATGGCCCAGCCAGTTGACCCGGCTCACAATGTCAGCCGCCTGCACCGGCT GCCCAGGGATTGCCAGGAGCTGTTCCAGGTTGGGGAGAGGCAGAGTGGACTATTTGAAATCCAGCCTC AGGGGTCTCCGCCATTTTTGGTGAACTGCAAGATGACCTCAGATGGAGGCTGGACAGTAATTCAGAGG CGCCACGATGGCTCAGTGGACTTCAACCGGCCCTGGGAAGCCTACAAGGCGGGGTTTGGGGATCCCCA CGGCGAGTTCTGGCTGGGTCTGGAGAAGGTGCATAGCATCACGGGGGACCGCAACAGCCGCCTGGCC GTGCAGCTGCGGGACTGGGATGGCAACGCCGAGTTGCTGCAGTTCTCCGTGCACCTGGGTGGCGAGGA CACGGCCTATAGCCTGCAGCTCACTGCACCCGTGGCCGGCCAGCTGGGCGCCACCACCGTCCCACCCA GCGGCCTCTCCGTACCCTTCTCCACTTGGGACCAGGATCACGACCTCCGCAGGGACAAGAACTGCGCC AAGAGCCTCTCTGGAGGCTGGTGGTTTGGCACCTGCAGCCATTCCAACCTCAACGGCCAGTACTTCCGC TCCATCCCACAGCAGCGGCAGAAGCTTAAGAAGGGAATCTTCTGGAAGACCTGGCGGGGCCGCTACTA CCCGCTGCAGGCCACCACCATGTTGATCCAGCCCATGGCAGCAGAGGCAGCCTCCTAG (SEQ ID NO:475). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

A preferred polypeptide fragment of the invention comprises, or alternatively consists of, the following amino acid sequence: MAQWTSTGPGKPTRR GLGIPTASSGWVWRRCIASWGTATAAW-PCSCGTGMATPSCCSSPCTWVARTRPI-ACSSLHPWPASWAPPPS HPAASPYPSPLGTRITT-SAGTRTAPRASLEAGGLAPAAIPTFNGPVLPAPSHSS-GRSLRRESSGRPAGRYYPLQ ATTMLIQPMAAEAAS (SEQ ID NO: 476). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

The translated product of this gene contains a Fibrinogen beta and gamma chains C-terminal domain signature (consensus pattern WW[LIVMFYW].{2}C.{2}[GSA].{2}NG; PROSITE entry PD0000445, Swiss Institute of Bioinformatics). Fibrinogen, the principal protein of vertebrate blood clotting is an hexamer containing two sets of three different chains (alpha, beta, and gamma), linked to each other by disulfide bonds. The N-terminal sections of these three chains are evolutionary related and contain the cysteines that participate in the cross-linking of the chains. However, there is no similarity between the C-terminal part of the alpha chain and that of the beta and gamma chains. The C-terminal part of the beta and gamma chains forms a domain of about 270 amino-acid residues. Fibrinogen beta and gamma chains C-terminal domains may be important for regulating protein-protein interactions. For references on these domains see Doolittle R.F., Annu. Rev. Biochem. 53:195-229(1984) and Xu X., and Doolittle R.F., Proc. Natl. Acad. Sci. U.S.A. 87:2097-2101 (1990); all refences are hereby incorporated herein by reference.

Preferred polypeptides of the invention comprise, or alternatively consist of, an amino acid sequence selected from the group: WWFGTCSHSNLNG (SEQ ID NO: 477) and SGG-WWFGTCSHSNLNGQYF (SEQ ID NO: 478). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

The gene encoding the disclosed cDNA is believed to reside on chromosome 19. Accordingly, polynucleotides related to this invention are useful as a marker in linkage analysis for chromosome 19.

This gene is expressed in oseteoarthritic tissues, kidney cortex, bone marrow, larynx carcinoma, and pineal gland, and to a lesser extent in placenta, stromal cells, epithelioid sarcoma, and a variety of other cells and tissues.

Polynucleotides and polypeptides of the invention are useful as reagents for differential identification of the tissue(s) or cell type(s) present in a biological sample and for diagnosis of diseases and conditions which include, but are not limited to, arthritis, kidney and urinary tract disorders, immune cell and system dysfunctions, disorders of the pineal gland and brain, and carcinomas, particularly of the larnyx. Similarly, polypeptides and antibodies directed to these polypeptides are useful in providing immunological probes for differential identification of the tissue(s) or cell type(s). For a number of disorders of the above tissues or cells, particularly those of the immune, connective, endocrine, and urinary systems, expression of this gene at significantly higher or lower levels may be routinely detected in certain tissues or cell types (e.g., cancerous and wounded tissues) or bodily fluids (e.g., serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 208 as residues: Pro-27 to Arg-34, Glu-60 to Gln-65, Cys-80 to Thr-87, Leu-109 to Ile-116, Ala-124 to Gln-133, Lys-158 to Leu-165, Arg-229 to Ser-234, Asp-236 to Trp-241, Thr-266 to Ser-271, Thr-328 to Lys-343, Ser-355 to Tyr-363, Ile-367 to Lys-376, Thr-382 to Tyr-387. Polynucleotides encoding said polypeptides are also encompassed by the invention.

The tissue distribution and homology to angiopoietin-2 indicates that polynucleotides and polypeptides corresponding to this gene are useful for the regulation of angiogenesis, particularly since angiogenesis is thought to depend on a precise balance of positive and negative regulation. Angiopoietin-1 (Ang1) is an angiogenic factor that signals through the endothelial cell-specific Tie2 receptor tyrosine kinase and, like vascular endothelial growth factor, is essential for normal vascular development in the mouse. Angiopoietin-2 is a naturally occurring antagonist for Angiopoietin-1 and Tie2. Transgenic overexpression of Angiopoietin-2 disrupts blood vessel formation in the mouse embryo. In adult mice and humans, Angiopoietin-2 is expressed only at sites of vascular remodeling. As such, this gene, or antagonists thereof, are useful in the diagnosis and treatment of arthritis, bone growth and remodeling, cancers (particularly those of bone, connective, lymphatic, and vascular tissues), ischaemia, lymphangiogenesis, lymphadnitis, lymphadenoma, lymphadenosis, lymphangitis, lymphangioendothelioma, lymphangioma, lymphangiophlebitis, lymphangiosarcom, lymphatitis, lymphedema, lymphenteritis, angioma, angiomegaly, amgiomyosarcoma, amgiomyoma, angiomyolipoma, angiomyoneuroma, angioneuromyoma, angiosarcoma, angiostenosis, angiotelectasis, and as a lymphagogue.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 76

The translation product of this gene was shown to have homology to the DPM2 mannosyl transferase gene, which is known to be important in O-linked oligosaccaride glycosylation of proteins. Mutations within this gene have been shown to result in reduced levels of O-linked glycosylation. Since defects in proper protein glycosylation can result in the development of antigen-specific antibodies to such protein or altered pharmacokinetics (i.e., plasma half-life, in vivo clearance rate, etc.), the protein product of this gene may show utility in the treatment, diagnosis, and/or prevention of various abnormalities involving oligosaccaride metabolism, specifically those associated with O-glycosylation (See Genebank Accession No.R47201).

Preferred polypeptides of the invention comprise, or alternatively consist of, an amino acid selected from the group: GHDLPQDAWLRWVLAGALCAGGWA VNYLPFFL (SEQ ID NO: 479), and/or FLYHYLPALTFQILLLPV (SEQ ID NO: 480). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

The gene encoding the disclosed cDNA is believed to reside on chromosome 9. Accordingly, polynucleotides related to this invention are useful as a marker in linkage analysis for chromosome 9.

This gene is expressed in brain and melanocytes and to a lesser extent in breast, testis, and colon.

Polynucleotides and polypeptides of the invention are useful as reagents for differential identification of the tissue(s) or cell type(s) present in a biological sample and for diagnosis of diseases and conditions which include, but are not limited to, cancers, particularly of the brain and melanocyte, in addition to neurological disorders. Similarly, polypeptides and antibodies directed to these polypeptides are useful in providing immunological probes for differential identification of the tissue(s) or cell type(s). For a number of disorders of the above tissues or cells, particularly of the brain, central nervous system, PNS, epithelial tissues including other parts of the integumentary system, expression of this gene at significantly higher or lower levels may be routinely detected in certain tissues or cell types (e.g., neural, cancerous and wounded tissues) or bodily fluids (e.g. lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 209 as residues: His-31 to Gln-38, Tyr-65 to Ser-71. Polynucleotides encoding said polypeptides are also encompassed by the invention.

The tissue distribution in brain tissue, combined with the homology to a known enzyme involved in oligosaccaride metabolism, indicates polynucleotides and polypeptides corresponding to this gene are useful for the detection, treatment, and/or prevention of neurodegenerative disease states, behavioral disorders, or inflammatory conditions. Representative uses are described in the "Regeneration" and "Hyperproliferative Disorders" sections below, in Example 11, 15, 39, 41, 42, 43, and 51, and elsewhere herein. Briefly, the uses include, but are not limited to the detection, treatment, and/or prevention of Alzheimer's Disease, Parkinson's Disease, Huntington's Disease, Tourette Syndrome, meningitis, encephalitis, demyelinating diseases, peripheral neuropathies, neoplasia, trauma, congenital malformations, spinal cord injuries, ischemia and infarction, aneurysms, hemorrhages, schizophrenia, mania, dementia, paranoia, obsessive compulsive disorder, depression, panic disorder, learning disabilities, ALS, psychoses, autism, and altered behaviors, including disorders in feeding, sleep patterns, balance, and perception. In addition, elevated expression of this gene product in regions of the brain indicates it plays a role in normal neural function. Potentially, this gene product is involved in synapse formation, neurotransmission, learning, cognition, homeostasis, or neuronal differentiation or survival.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 77

Preferred polypeptides of the invention comprise, or alternatively consist of, an amino acid sequence selected from the group: DICRLERAVCRDEPSAL ARALTWRQARAQAGA (SEQ ID NO: 482), XAPATXAWDTVVPPLPRKC QCSGSARSHGAGRSALHSPLEGSRPKVPAGAVGKSLPGQSRPQHCLPPKQPKQCRPGLELKEGPLLTPTRASVQLSHPACLYWAPLLWIRDPASV (SEQ ID NO: 483), XAPATXAWDTVVPPLPRKCQCSGSARSHGAGRSALHSPLEGSRPKVPAGAVGKSL (SEQ ID NO: 484), PGQSRPQHCLPPKQPKQCRPGLELKEGPLLTPT RASVQLSHPACLYWAPLLWIRDPASV (SEQ ID NO: 485), and/or MSPLPWPGPLPGGRQGHRLEPCCSSGCAGGPTWPHCSSQSWPMXSARHXGLGHCCPSSP (SEQ ID NO: 481). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

In another embodiment, polypeptides comprising the amino acid sequence of the open reading frame upstream of the predicted signal peptide are contemplated by the present invention. Specifically, polypeptides of the invention comprise, or alternatively consist of, the following amino acid sequence: DICRLERAVCRDEP SALARALTWRQARAQAGAMLLFGLCWGPYVATLLLS-VLAYXQRPPLXPGTLLSLLSLGSASAAAVPVAM GLGDQRYTAPWRAAAQRCLQGLWGRAS-RDSPGPSIAYHPSSQSSVDLDLN (SEQ ID NO: 486). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

This gene is expressed in cells of the immune system, including dendritic cells and T cells.

Polynucleotides and polypeptides of the invention are useful as reagents for differential identification of the tissue(s) or cell type(s) present in a biological sample and for diagnosis of diseases and conditions which include, but are not limited to, diseases and/or disorders affecting the immune system, particularly immunodeficiencies such as AIDS. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., immune, and cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in dendritic and T cells indicates that polynucleotides and polypeptides corresponding to this gene are useful for the diagnosis, treatment and/or prevention of a variety of immune system disorders. Representative uses are described in the "Immune Activity" and "Infectious Disease" sections below, in Example 11, 13, 14, 16, 18, 19, 20, 32, 33, 34, 53, and 58, and elsewhere herein. Expression of this gene product in tonsils indicates a role in the regulation of the proliferation; survival; differentiation; and/or activation of potentially all hematopoietic cell lineages, including blood stem cells. This gene product may be involved in the regulation of cytokine production, antigen presentation, or other processes that may also suggest a usefulness in the treatment of cancer e.g., by boosting immune responses. Expression in cells of lymphoid origin, the natural gene product may be involved in immune functions. Therefore it may be also used as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersensitivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus erythematosis, drug induced hemolytic anemia, rheumatoid arthritis, Sjogren's disease, scleroderma and tissues.

Moreover, the protein may represent a secreted factor that influences the differentiation or behavior of other blood cells, or that recruits hematopoietic cells to sites of injury. In addition, this gene product may have commercial utility in the expansion of stem cells and committed progenitors of various blood lineages, and in the differentiation and/or proliferation of various cell types.

Furthermore, the protein may also be used to determine biological activity, raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 78

Preferred polypeptides of the invention comprise, or alternatively consist of, an amino acid sequence selected from the group: MERVGMESGEMVCGLGSACNNPSDLGQVPVPLWXSVSPPVFGXGWNGH (SEQ ID NO: 487), MRSFQDVSALEEWRGGKDLEPTHSLLLLLPLRDLLVVL GEIRKRQMEGCVWKGWGWNPE KWFAVLALPVTTRVTLGKSLSLSGXQFLHLYLERVGMGTEVLSSSDLL (SEQ ID NO: 488), MHPAGPTFMGSKPIREQQFG PDACLLLLCVAMAGTEAS-RAAQQCTSQKVRAGQDFSAHSNPX-QIQVEKLXPREGQGLAQGHSGCYRQSQ DRKPFLRIPSPPFPYTTLHLPFPDFAKNH (SEQ ID NO: 489), MHPAGPTFMGSKPIREQQFGPDACLLLLCVAMAGTEAS-RAAQQCTSQKVRAGQDFSAHSNP (SEQ ID NO: 490), PREGQGLAQGHSGCYRQSQDRKPFLRIP SPPFPYTTLHLPFPDFAKNH (SEQ ID NO: 491), DPRVRKPP TATLTTARTRPTTD (SEQ ID NO: 492), and/or AALEASVPAIATQRSSRQ ASGPNCCSLMGLDPMKVGPAGCISWDSVEADQVAGASGGRIEVKGCG-MENLXRLHLGSGKGQXX (SEQ ID NO: 493). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

This gene is expressed in prostate and gall bladder.

Polynucleotides and polypeptides of the invention are useful as reagents for differential identification of the tissue(s) or cell type(s) present in a biological sample and for diagnosis of diseases and conditions which include, but are not limited to, disorders affecting the reproductive and gastrointestinal systems, including cancer. Similarly, polypeptides and antibodies directed to these polypeptides are useful in providing immunological probes for differential identification of the tissue(s) or cell type(s). For a number of disorders of the above tissues or cells, particularly of the reproductive and urogenital systems, expression of this gene at significantly higher or lower levels may be routinely detected in certain tissues or cell types (e.g., reproductive, cancerous and wounded tissues) or bodily fluids (e.g., lymph, bile, seminal fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 211 as residues: Arg-21 to Glu-30. Polynucleotides encoding said polypeptides are also encompassed by the invention.

The tissue distribution in gall bladder indicates that polynucleotides and polypeptides corresponding to this gene are useful for the diagnosis, prevention, and/or treatment of various metabolic disorders such as Tay-Sachs disease, phenylkenonuria, galactosemia, porphyrias, and Hurler's syndrome. In addition, expression of this gene product in the prostate—while likely to be reflective of non-specific expression of a variety of genes in the testes—may nevertheless be indicative of a role for this gene product in normal prostate function, and may implicate this gene product in male fertility, and could even suggest its use as a male contraceptive.

Furthermore, the protein may also be used to determine biological activity, raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 79

Preferred polypeptides of the invention comprise, or alternatively consist of, an amino acid selected from the group:

GXANPEDSVCILEGFSVTALSILQ HLVCHSGAVRLPITVRSGGRFCCWGRKQEPGSQXSDGD (SEQ ID NO: 495), AVQQQHRVPQTAHCPPLLVGPWGSPCPPHCQPLSVQHHRERSDHLHITLAVGASDWGQGALAHQA (SEQ ID NO: 496), PKTLPVISCPGSSVCSKCCQSASA QRHPCLACCWLLSSSPCWRTTTSWHLSSVPTQKAASCCCCTCTSHHGLTEWPWRHNGSSWNKRCGSWL SLVCKSPLPPVTGSNCQCNVEVVRALTVMLHRQWLTVRRAGGPPRTDQQRRTVRCLRDTVLLLHGLSQKD KLFMMHCVEVLHQFDQVMPGVSMLIRGLPDVTDCEE-AALDDLCAAETDVEDPEVECG (SEQ ID NO: 497), QSPLPPVTGSNCQCNVEVVRALTVML-

HRQWLTVRRAGGPPRTDQQRRTVRCL-
RDTVLLLHGLSQKDKLF MMHCVEVL-
HQFDQVMPGVSMLIRGLPDVTDCEEAALDDLCAAE-
TDVEDPEVECG (SEQ ID NO: 499), QSPLPPV TGSNC-
QCNVEVVRALTVMLHRQWLTVRRAGGP-
PRTDQQRRTVRCLRDTVLLLHGLS (SEQ ID NO: 500),
QKDKLFMMHCVEVLHQFDQVMPGVSMLIRGLP
DVTDCEEAALDDLCAAETDVEDPEVECG (SEQ ID
NO: 501), CLRDTVLLLH GLSQKDKLFMMHCVEVL-
HQFDQVMPGVSMLIRGLPDVTDC (SEQ ID NO: 502),
and/or MLHRQWLTVRRAGGPPRTDQQRRTVRCL-
RDTVLLLHGLSQKDK LFMMHCVEVL-
HQFDQVMPGVSMLIRGLPDVTDCEE-
AALDDLCAAETDVEDPEVECG (SEQ ID NO: 494).
Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

In another embodiment, polypeptides comprising the amino acid sequence of the open reading frame upstream of the predicted signal peptide are contemplated by the present invention. Specifically, polypeptides of the invention comprise, or alternatively consist of, the following amino acid sequence: GXANPEDSVC ILEGFSVTALSILQHLVCHS-
GAVRLPITVRSGGRFCCWGRKQEPGSQX-
SDGDMTSALRGVADDQGQHPLLK MLLHLLAFS-
SAATGHLQASVLTQCLKVLVKLAENTSCDFLPRFQC-
VFQVLPKCLSPETPLPSVLLAVELLSL LADH-
DQLAPQLCSHSEGCLLLLLYMYITSRP-
DRVALETQWLQLEQEVVWLLAKLGVQE-
PLAPSHWLQLPV (SEQ ID NO: 498). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

The gene encoding the disclosed cDNA is believed to reside on chromosome 3. Accordingly, polynucleotides related to this invention are useful as a marker in linkage analysis for chromosome 3.

This gene is expressed in breast, prostate, and to a lesser extent in testes.

Polynucleotides and polypeptides of the invention are useful as reagents for differential identification of the tissue(s) or cell type(s) present in a biological sample and for diagnosis of diseases and conditions which include, but are not limited to, disorders affecting the reproductive organs of both males and females, especially cancers. Similarly, polypeptides and antibodies directed to these polypeptides are useful in providing immunological probes for differential identification of the tissue(s) or cell type(s). For a number of disorders of the above tissues or cells, particularly of the reproductive system, expression of this gene at significantly higher or lower levels may be routinely detected in certain tissues or cell types (e.g., reproductive, cancerous and wounded tissues) or bodily fluids (e.g., lymph, amniotic fluid, seminal fluid, breast milk, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution primarily in breast, prostate, and to a lesser extent in testes indicates that polynucleotides and polypeptides corresponding to this gene are useful for the diagnosis and treatment of disorders affecting the reproductive organs of males and females, including but not limited to cancers.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 80

The translation product of this gene shares sequence homology with epsilon-COP which is part of coatomers which are thought to be important in maintaining Golgi structure and in mediating ER-through-Golgi transport, and which can influence normal endocytic recycling of LDL receptors (See Genebank Accession No. gi|2443869 (AC002985); all references available through this accession are hereby incorporated by reference herein).

Preferred polypeptides of the invention comprise, or alternatively consist of, an amino acid sequence selected from the group: MSGQLDARPAAALHPQGLAHPLWTCLL-
PRKGPSEVPQRPPQLWVVSISVLQGQHR-
GRAGPRDEQSVDVTN TTFLLMAASIYLHDQNP-
DAALRALHQGDSLEW (SEQ ID NO: 503),
SVDVTNTTFLLMAASIYLHD (SEQ ID NO: 504), QNP-
DAALRALHQGDSLE (SEQ ID NO: 505), and/or RDSI-
VAELDREMSR (SEQ ID NO: 506). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

A preferred polypeptide fragment of the invention comprises, or alternatively consists of, the following amino acid sequence: MLGLLLLCTPRAWLTLSGPVCFQ GRDPLR-
SHRGHPSCGS (SEQ ID NO: 507). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

The gene encoding the disclosed cDNA is believed to reside on chromosome 19. Accordingly, polynucleotides related to this invention are useful as a marker in linkage analysis for chromosome 19.

This gene is expressed in breast tissue.

Polynucleotides and polypeptides of the invention are useful as reagents for differential identification of the tissue(s) or cell type(s) present in a biological sample and for diagnosis of diseases and conditions which include, but are not limited to, disorders affecting the immune and reproductive systems, particularly of the mammary glands. Similarly, polypeptides and antibodies directed to these polypeptides are useful in providing immunological probes for differential identification of the tissue(s) or cell type(s). For a number of disorders of the above tissues or cells, particularly of the immune and reproductive systems, expression of this gene at significantly higher or lower levels may be routinely detected in certain tissues or cell types (e.g., reproductive, cancerous and wounded tissues) or bodily fluids (e.g., breast milk, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 213 as residues: Gly-24 to Gln-36, Gly-47 to His-66. Polynucleotides encoding said polypeptides are also encompassed by the invention.

The tissue distribution in breast tissue and homology to epsilon-COP indicates that polynucleotides and polypeptides corresponding to this gene are useful for the diagnosis and treatment of disorders affecting the immune and reproductive systems, including cancers, which arise from abnormalities in coatomer function, particularly of those tissues actively involved in secretory functions.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 81

The translation product of this gene shares sequence homology with the highly conserved epoxide hydrolase which is thought to have an important function in the catalysis of potentially toxic or carcinogenic epoxides into their corresponding, inert diols (See e.g., Genbank Accession No. gi|485136; all references available through this accession are hereby incorporated by reference herein).

Preferred polypeptides of the invention comprise, or alternatively consist of, an amino acid sequence selected from the group: HGFPEFWYSWR (SEQ ID NO: 508), ASHWLQQDQP (SEQ ID NO: 509), PINHYRNIF (SEQ ID NO: 510), YPEMVMKLI (SEQ ID NO: 511), PEFWYSWRYQLREF (SEQ ID NO: 512), HDWGGMIAW (SEQ ID NO: 513). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

This gene is expressed in benign and malignant prostate tissue.

Polynucleotides and polypeptides of the invention are useful as reagents for differential identification of the tissue(s) or cell type(s) present in a biological sample and for diagnosis of diseases and conditions which include, but are not limited to, disorders of the prostate and liver, particularly cancers. Similarly, polypeptides and antibodies directed to these polypeptides are useful in providing immunological probes for differential identification of the tissue(s) or cell type(s). For a number of disorders of the above tissues or cells, particularly of the reproductive system, expression of this gene at significantly higher or lower levels may be routinely detected in certain tissues or cell types (e.g., hepatic, prostate, cancerous and wounded tissues) or bodily fluids (e.g., lymph, seminal fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 214 as residues: Gln-38 to Pro-49, Glu-104 to Tyr-109, His-127 to Lys-132, Thr-236 to Cys-243, Gln-328 to Asp-333, Lys-344 to Asp-351. Polynucleotides encoding said polypeptides are also encompassed by the invention.

The tissue distribution in tumors of prostate origins indicates that polynucleotides and polypeptides corresponding to this gene are useful for diagnosis and intervention of these tumors, in addition to other tumors where expression has been indicated. Furthermore, the protein may also be used to determine biological activity, raise antibodies, as tissue markers, to isolate cognate ligands or receptors, to identify agents that modulate their interactions, in addition to its use as a nutritional supplement.

Protein, as well as, antibodies directed against the protein may show utility as a tumor marker and/or immunotherapy targets for the above listed tissues. Alternatively, homology to epoxide hydrolase indicates that polynucleotides and polypeptides corresponding to this gene are useful for the detection and treatment of liver disorders and cancers (e.g., hepatoblastoma, jaundice, hepatitis, liver metabolic diseases and conditions that are attributable to the differentiation of hepatocyte progenitor cells). In addition the expression in fetus would suggest a useful role for the protein product in developmental abnormalities, fetal deficiencies, pre-natal disorders and various would-healing models and/or tissue trauma.

Features of Protein Encoded by Gene No: 82

This gene is expressed in merkel cells.

Polynucleotides and polypeptides of the invention are useful as reagents for differential identification of the tissue(s) or cell type(s) present in a biological sample and for diagnosis of diseases and conditions which include, but are not limited to, disorders of the immune system. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g. immune, cancerous and wounded tissues) or bodily fluids (e.g. lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 215 as residues: Lys-23 to Lys-29. Polynucleotides encoding said polypeptides are also encompassed by the invention.

The tissue distribution indicates that polynucleotides and polypeptides corresponding to this gene are useful for the diagnosis and treatment of a variety of immune system disorders. Expression of this gene product in immune tissue indicates a role in the regulation of the proliferation; survival; differentiation; and/or activation of potentially all hematopoietic cell lineages, including blood stem cells. This gene product may be involved in the regulation of cytokine production, antigen presentation, or other processes that may also suggest a usefulness in the treatment of cancer e.g. by boosting immune responses. Expression in cells of lymphoid origin, the natural gene product may be involved in immune functions. Therefore it may be also used as an agent for immunological disorders including arthritis, asthma, immune deficiency diseases such as AIDS, and leukemia.

Protein, as well as, antibodies directed against the protein may show utility as a tumor marker and/or immunotherapy targets for the above listed tumors and tissues. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tumors and tissues.

Features of Protein Encoded by Gene No: 83

Preferred polypeptides comprise, or alternatively consist of, the following amino acid sequence: RLGAVLTPVIPAL-WEAEASRSPETRSLRPAW (SEQ ID NO: 514). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

This gene is expressed in liver tissue, particularly hepatomas.

Polynucleotides and polypeptides of the invention are useful as reagents for differential identification of the tissue(s) or cell type(s) present in a biological sample and for diagnosis of diseases and conditions which include, but are not limited to, disorders of the liver, including cancers. Similarly, polypeptides and antibodies directed to these polypeptides are useful in providing immunological probes for differential identification of the tissue(s) or cell type(s). For a number of disorders of the above tissues or cells, particularly of the hepatic and hematopoietic systems, expression of this gene at significantly higher or lower levels may be routinely detected in certain tissues or cell types (e.g., hepatic, cancerous and wounded tissues) or bodily fluids (e.g., lymph, bile, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 216 as residues: Met-1 to Ser-7, His-66 to Phe-72. Polynucleotides encoding said polypeptides are also encompassed by the invention.

The tissue distribution in liver indicates that polynucleotides and polypeptides corresponding to this gene are useful for the detection and treatment of liver disorders and cancers (e.g., hepatoblastoma, jaundice, hepatitis, liver metabolic diseases and conditions that are attributable to the differentiation of hepatocyte progenitor cells). In addition the expression in fetus would suggest a useful role for the protein product in developmental abnormalities, fetal deficiencies, pre-natal disorders and various would-healing models and/or tissue trauma.

Furthermore, the protein may also be used to determine biological activity, raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 84

Preferred polypeptides of the invention comprise, or alternatively consist of, the following amino acid sequence: GSLPPKPIYLVVPR (SEQ ID NO: 515). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

This gene is expressed in skin.

Polynucleotides and polypeptides of the invention are useful as reagents for differential identification of the tissue(s) or cell type(s) present in a biological sample and for diagnosis of diseases and conditions which include, but are not limited to, disorders affecting the skin, such as melanoma and wound healing, in addition to other disorders affecting the integumentary system. Similarly, polypeptides and antibodies directed to these polypeptides are useful in providing immunological probes for differential identification of the tissue(s) or cell type(s). For a number of disorders of the above tissues or cells, particularly of the immune system and skin, expression of this gene at significantly higher or lower levels may be routinely detected in certain tissues or cell types (e.g., epithelial, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 217 as residues: Cys-56 to Pro-73, Pro-83 to Lys-92. Polynucleotides encoding said polypeptides are also encompassed by the invention.

The tissue distribution in skin and skin melanoma indicates that polynucleotides and polypeptides corresponding to this gene are useful for diagnosis and intervention of various skin disorders including skin tumors, in addition to other tumors where expression has been indicated. Representative uses are described in the "Biological Activity", "Hyperproliferative Disorders", "Infectious Disease", and "Regeneration" sections below, in Example 11, 19, and 20, and elsewhere herein. Briefly, the protein is useful in detecting, treating, and/or preventing congenital disorders (i.e. nevi, moles, freckles, Mongolian spots, hemangiomas, port-wine syndrome), integumentary tumors (i.e. keratoses, Bowen's disease, basal cell carcinoma, squamous cell carcinoma, malignant melanoma, Paget's disease, mycosis fungoides, and Kaposi's sarcoma), injuries and inflammation of the skin (i.e. wounds, rashes, prickly heat disorder, psoriasis, dermatitis), atherosclerosis, uticaria, eczema, photosensitivity, autoimmune disorders (i.e., lupus erythematosus, vitiligo, dermatomyositis, morphea, scleroderma, pemphigoid, and pemphigus), keloids, striae, erythema, petechiae, purpura, and xanthelasma. In addition, such disorders may predispose increased susceptibility to viral and bacterial infections of the skin (i.e., cold sores, warts, chickenpox, molluscum contagiosum, herpes zoster, boils, cellulitis, erysipelas, impetigo, tinea, althlete's foot, and ringworm).

Moreover, the protein product of this gene may also be useful for the treatment or diagnosis of various connective tissue disorders (i.e., arthritis, trauma, tendonitis, chrondomalacia and inflammation, etc.), autoimmune disorders (i.e., rheumatoid arthritis, lupus, scleroderma, dermatomyositis, etc.), dwarfism, spinal deformation, joint abnormalities, amd chondrodysplasias (i.e. spondyloepiphyseal dysplasia congenita, familial osteoarthritis, Atelosteogenesis type II, metaphyseal chondrodysplasia type Schmid).

Furthermore, the protein may also be used to determine biological activity, raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 85

When tested against kidney K562 cell lines, supernatants removed from cells containing this gene activated the interferon-sensitive responsive element (ISRE) pathway. Thus, it is likely that this gene activates kidney or endothelial cells through the ISRE signal transduction pathway. ISRE is a promoter element found upstream in many genes which are involved in the Jaks-STAT pathway. The Jaks-STAT pathway is a large, signal transduction pathway involved in the differentiation and proliferation of cells. Therefore, activation of the Jaks-STATs pathway, reflected by the binding of the ISRE element, can be used to indicate proteins involved in the proliferation and differentiation of cells. This gene maps to chromosome 10, and therefore, may be used as a marker in linkage analysis for chromosome 10.

This gene is expressed in placenta, and to a lesser extent in many other tissues or cells.

Polynucleotides and polypeptides of the invention are useful as reagents for differential identification of the tissue(s) or cell type(s) present in a biological sample and for diagnosis of diseases and conditions which include, but are not limited to, vascular disease including occlusion of vessels and arteries. Similarly, polypeptides and antibodies directed to these polypeptides are useful in providing immunological probes for differential identification of the tissue(s) or cell type(s). For a number of disorders of the above tissues or cells, particularly of the vascular system, expression of this gene at significantly higher or lower levels may be routinely detected in certain tissues or cell types (e.g., reproductive, cancerous and wounded tissues) or bodily fluids (e.g., lymph, amniotic fluid, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 218 as residues: His-58 to Gly-68, Thr-76 to Arg-81. Polynucleotides encoding said polypeptides are also encompassed by the invention.

The tissue distribution in placenta combined with the biological activity data indicates that polynucleotides and polypeptides corresponding to this gene are useful for the diagnosis and treatment of cancer and other proliferative disorders. Expression within highly vascularized tissue and other cellular sources marked by proliferating cells indicates that this protein may play a role in the regulation of cellular division. Additionally, the expression in placenta indicates that this protein may play a role in the proliferation, differentiation, and/or survival of hematopoietic cell lineages. In such an event, this gene may be useful in the treatment of lymphoproliferative disorders, and in the maintenance and differentiation of various hematopoietic lineages from early hematopoietic stem and committed progenitor cells. Similarly, embryonic development also involves decisions involving cell differentiation and/or apoptosis in pattern formation. Thus this protein may also be involved in apoptosis or tissue differentiation and could again be useful in cancer therapy.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 86

This gene is Apolipoprotein M (See, e.g., Genbank Accession No. gb|AAD18084.1|(AF129756) and gb|AAD11443.1|(AF118393); all references available through these accessions are hereby incorporated by reference herein). The protein components of human lipoproteins, apolipoproteins, allow the redistribution of cholesterol from the arterial wall to other tissues and exert beneficial effects on systems involved in the development of arterial lesions, like inflammation and hemostasis.

The gene encoding the disclosed cDNA is believed to reside on chromosome 6. Accordingly, polynucleotides related to this invention are useful as a marker in linkage analysis for chromosome 6.

This gene is expressed in fetal liver, fetal spleen, and to a lesser extent in adult liver, hepatocellular tumors, retina and testis.

Polynucleotides and polypeptides of the invention are useful as reagents for differential identification of the tissue(s) or cell type(s) present in a biological sample and for diagnosis of diseases and conditions which include, but are not limited to, proliferative disorders of the blood and tumors of the liver or disorders of lipid metabolism. Similarly, polypeptides and antibodies directed to these polypeptides are useful in providing immunological probes for differential identification of the tissue(s) or cell type(s). For a number of disorders of the above tissues or cells, particularly of the immune, metabolic, and hepatic systems, expression of this gene at significantly higher or lower levels may be routinely detected in certain tissues or cell types (e.g., liver, hematopoietic, cancerous and wounded tissues) or bodily fluids (e.g., bile, lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 219 as residues: Glu-106 to Lys-120, Glu-136 to Tyr-141, Asn-148 to Pro-154. Polynucleotides encoding said polypeptides are also encompassed by the invention.

The tissue distribution of the gene product, ApoM, in fetal liver, and adult liver indicates that polynucleotides and polypeptides corresponding to this gene are useful for the diagnosis, treatment and prevention of lipid metabolism disorders, including but not limited to, vascular disease, such as coronary artery disease, arteriosclerosis, and/or atherosclerosis Additionally, the tissue distribution in fetal liver and spleen indicates that polynucleotides and polypeptides corresponding to this gene are useful for the diagnosis and treatment of a variety of immune system disorders. Representative uses are described in the "Immune Activity" and "Infectious Disease" sections below, in Example 11, 13, 14, 16, 18, 19, 20, 32, 33, 34, 53, and 58, and elsewhere herein. Briefly, the expression of this gene product in fetal tissues indicates a role in regulating the proliferation; survival; differentiation; and/or activation of potentially all hematopoietic cell lineages, including blood stem cells. This gene product may be involved in the regulation of cytokine production, antigen presentation, or other processes that may also suggest a usefulness in the treatment of cancer e.g., by boosting immune responses. Expression in cells of lymphoid origin, the natural gene product may be involved in immune functions. Therefore it may be also used as an agent for immunological disorders including arthritis, asthma, immune deficiency diseases such as AIDS, and leukemia. In addition, this gene product may have commercial utility in the expansion of stem cells and committed progenitors of various blood lineages, and in the differentiation and/or proliferation of various cell types.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Alternatively, expression within liver tissues indicates that polynucleotides and polypeptides corresponding to this gene are useful for the detection and treatment of liver disorders and cancers (e.g. hepatoblastoma, jaundice, hepatitis, liver metabolic diseases and conditions that are attributable to the differentiation of hepatocyte progenitor cells). In addition the expression in fetus would suggest a useful role for the protein product in developmental abnormalities, fetal deficiencies, pre-natal disorders and various would-healing models and/or tissue trauma.

Features of Protein Encoded by Gene No: 87

This gene is expressed in LPS treated neutrophils.

Polynucleotides and polypeptides of the invention are useful as reagents for differential identification of the tissue(s) or cell type(s) present in a biological sample and for diagnosis of diseases and conditions which include, but are not limited to, chronic or acute inflammatory disease, and hematopoietic disorders. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., hematopoietic, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in neutrophils indicates that polynucleotides and polypeptides corresponding to this gene are useful for the treatment and diagnosis of hematopoietic related disorders such as anemia, pancytopenia, leukopenia, thrombocytopenia or leukemia since stromal cells are important in the production of cells of hematopoietic lineages. Representative uses are described in the "Immune Activity" and "Infectious Disease" sections below, in Example 11, 13, 14, 16, 18, 19, 20, 32, 33, 34, 53, and 58, and elsewhere herein. Briefly, the uses include bone marrow cell ex-vivo culture, bone marrow transplantation, bone marrow reconstitution, radiotherapy or chemotherapy of neoplasia.

The gene product may also be involved in lymphopoiesis, therefore, it can be used in immune disorders such as infection, inflammation, allergy, immunodeficiency, etc. In addition, this gene product may have commercial utility in the expansion of stem cells and committed progenitors of various blood lineages, and in the differentiation and/or proliferation of various cell types.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 88

The translation product of this gene shares sequence homology with prolylcarboxypeptidase which is thought to be important in the processing of bioactive peptides like angiotensin and bradykinin (See Genbank Accession No. gb|AAA99891.1|; all references available through this accession are hereby incorporated by reference herein).

Preferred polypeptides comprise, or alternatively consist of, an amino acid sequence selected from the group: LVFAEHRYYGKSLPFG (SEQ ID NO: 516), EQALADFAEL (SEQ ID NO: 517), GGSYGGMLSAYLRMKYPH (SEQ ID NO: 518), NIIFSNGNLDPWAGGG (SEQ ID NO: 519), AMMDYPYPTDFLGP LPANPVKV (SEQ ID NO: 520), and/or FYTGNEGD (SEQ ID NO: 521). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

An additional preferred polypeptide fragment of the invention comprises, or alternatively consists of, the following amino acid sequence:

MGSAPWAPVLLLALGLRGLQAGARSG-
PRLPGALLPAASGPLQLRALRQQDLP-
SALPGVGQVLGPRGAHL LLHWERGRRVGL-
RQQLGLRRGLAAERGALLVFAEHRYYGKSLPFGAQS-
TQRGHTELLTVEQALADFAELL RALRRDLGAQDA-
PAIAFGGSYGGMLSAYLRMKYPHLVAGA-
LAASAPVLSVAGLGDSNQFFRDVTADFEG QSP-
KCTQGVREAFRQIKDLFLQGAYDTVRWEFGTCQPLS-
DEKDLTQLFMFARNAFTVLAMMDYPYPTDFL
GPLPANPVKVGCDRLLSEAQRITGL-

RALAGLVYNASGSEHCYDIYRLYH-
SCADPTGCGTGPDARAWDYQA CTEINLTFASNNVT-
DMFPDLPFTDELRQRYCLDTWGVWPRPDWLLTSFW-
GGDLRAASNIIFSNGNLDPWA GGGIRRNLSASVIA-
VTIQGGAHHLDLRASHPEDPASVVEAR-
KLEATIIGEWVKAARREQQPALRGGPRLSL (SEQ ID NO: 522). Moreover, fragments and variants of this polypeptide (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

This gene is expressed in uterine cancer, testis, and to a lesser extent in lymph nodes, dendritic cells and HL60 cell line.

Polynucleotides and polypeptides of the invention are useful as reagents for differential identification of the tissue(s) or cell type(s) present in a biological sample and for diagnosis of diseases and conditions which include, but are not limited to, uterine cancer, reproductive, and immune disorders. Similarly, polypeptides and antibodies directed to these polypeptides are useful in providing immunological probes for differential identification of the tissue(s) or cell type(s). For a number of disorders of the above tissues or cells, particularly of the reproductive system, expression of this gene at significantly higher or lower levels may be routinely detected in certain tissues or cell types (e.g., reproductive, cancerous and wounded tissues) or bodily fluids (e.g., amniotic fluid, seminal fluid, lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 221 as residues: Gly-23 to Ala-30, Pro-44 to Phe-54, Glu-69 to Pro-77, Gln-142 to His-148, Phe-232 to Gly-242, Pro-271 to Leu-278, Ser-340 to Asp-347, Pro-365 to Asp-371, Asp-398 to Leu-406, Arg-500 to Pro-505. Polynucleotides encoding said polypeptides are also encompassed by the invention.

The tissue distribution in uterine cancer and homology to prolylcarboxypeptidase indicates that the protein product of this gene would is useful for diagnosis, treatment and prevention of diseases associated with the reproductive system including uterine cancer, as well as, cardiovascular diseases where prolylcarboxypeptidases primary substrate, angiotensin, has its greatest affect. In addition, the putative location of prolylcarboxypeptidase within the lysosomal compartment of cells indicates that polynucleotides and polypeptides corresponding to this gene are useful for the diagnosis, prevention, and/or treatment of various metabolic disorders such as Tay-Sachs disease, phenylkenonuria, galactosemia, porphyrias, and Hurler's syndrome.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 89

The translation product of this gene shares sequence homology with the human CGI-06 protein (See, e.g. Genbank Accession No. gb|AAD27715.1|AF132940_1 (AF132940); all references available through this accession are hereby incorporated by reference herein).

When tested against the myeloid cell line, U937, supernatants removed from cells containing this gene activated the GAS (gamma activation site) pathway. Thus, it is likely that this gene activates myeloid cells through the Jaks-STAT signal transduction pathway. The GAS (gamma activation site) is a promoter element found upstream in many genes which are involved in the Jaks-STAT pathway. The Jaks-STAT pathway is a large, signal transduction pathway involved in the differentiation and proliferation of cells. Therefore, activation of the Jaks-STATs pathway, reflected by the binding of the GAS element, can be used to indicate proteins involved in the proliferation and differentiation of cells.

The gene encoding the disclosed cDNA is believed to reside on chromosome 20. Accordingly, polynucleotides related to this invention are useful as a marker in linkage analysis for chromosome 20.

This gene is expressed in various tumors including endometrial tumors, adenocarcinoma, breast cancer, osteosarcoma, chondrosarcoma, uterine and pancreas tumors and to a lesser extent in embryonic tissues.

Polynucleotides and polypeptides of the invention are useful as reagents for differential identification of the tissue(s) or cell type(s) present in a biological sample and for diagnosis of diseases and conditions which include, but are not limited to, identification and treatment of many types of solid tumors. Similarly, polypeptides and antibodies directed to these polypeptides are useful in providing immunological probes for differential identification of the tissue(s) or cell type(s). For a number of disorders of the above tissues or cells, particularly of the major organs, expression of this gene at significantly higher or lower levels may be routinely detected in certain tissues or cell types (e.g., skeletal, reproductive, cancerous and wounded tissues) or bodily fluids (e.g., breast milk, lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 222 as residues: Pro-25 to Arg-31, Thr-52 to Val-63, Asn-129 to Lys-135, Gln-197 to Trp-202, Thr-230 to Glu-236, Pro-242 to Tyr-248, Leu-280 to Pro-291, Ser-348 to Ser-356, Pro-362 to Gln-368, Thr-398 to His-406, Trp-430 to Leu-435, Glu-499 to Gly-504. Polynucleotides encoding said polypeptides are also encompassed by the invention.

The tissue distribution in solid tumors combined with the GAS-element activity indicates that polynucleotides and polypeptides corresponding to this gene are useful for the diagnosis and treatment of cancer and other proliferative disorders. Expression within embryonic tissue and other cellular sources marked by proliferating cells indicates that this protein may play a role in the regulation of cellular division. Representative uses are described in the "Hyperproliferative Disorders" and "Regeneration" sections below and elsewhere herein. Briefly, developmental tissues rely on decisions involving cell differentiation and/or apoptosis in pattern formation. Dysregulation of apoptosis can result in inappropriate suppression of cell death, as occurs in the development of some cancers, or in failure to control the extent of cell death, as is believed to occur in acquired immunodeficiency and certain neurodegenerative disorders, such as spinal muscular atrophy (SMA). Because of potential roles in proliferation and differentiation, this gene product may have applications in the adult for tissue regeneration and the treatment of cancers. It may also act as a morphogen to control cell and tissue type specification. Therefore, the polynucleotides and polypeptides of the present invention are useful in treating, detecting, and/or preventing said disorders and conditions, in addition to other types of degenerative conditions. Thus this protein may modulate apoptosis or tissue differentiation and is useful in the detection, treatment, and/or prevention of degenerative or proliferative conditions and diseases. The protein is useful in modulating the immune response to aberrant polypeptides, as may exist in proliferating and cancerous cells and tissues. The protein can also be used to gain new insight into the regulation of cellular growth and proliferation.

Additionally, the expression in hematopoietic cells and tissues indicates that this protein may play a role in the proliferation, differentiation, and/or survival of hematopoietic cell lineages. In such an event, this gene may be useful in the treatment of lymphoproliferative disorders, and in the maintenance and differentiation of various hematopoietic lineages from early hematopoietic stem and committed progenitor cells.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 90

This gene is expressed in brain medulloblastoma cells.

Polynucleotides and polypeptides of the invention are useful as reagents for differential identification of the tissue(s) or cell type(s) present in a biological sample and for diagnosis of brain medulloblastoma and other neurological disorders. Similarly, polypeptides and antibodies directed to these polypeptides are useful in providing immunological probes for differential identification of the tissue(s) or cell type(s). For a number of disorders of the above tissues or cells, particularly of the central nervous system, expression of this gene at significantly higher or lower levels may be routinely detected in certain tissues or cell types (e.g., neural, cancerous and wounded issues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in medulloblastoma indicates that polynucleotides and polypeptides corresponding to this gene are useful for the detection, treatment, and/or prevention of neurodegenerative disease states, behavioral disorders, or inflammatory conditions Representative uses are described in the "Regeneration" and "Hyperproliferative Disorders" sections below, in Example 11, 15, 39, 41, 42, 43, and 51, and elsewhere herein. Briefly, the uses include, but are not limited to the detection, treatment, and/or prevention of Alzheimer's Disease, Parkinson's Disease, Huntington's Disease, Tourette Syndrome, schizophrenia, mania, dementia, paranoia, obsessive compulsive disorder, panic disorder, learning disabilities, ALS, psychoses, autism, and altered behaviors, including disorders in feeding, sleep patterns, balance, and perception.

In addition, the gene or gene product may also play a role in the treatment and/or detection of developmental disorders associated with the developing embryo or disorders of the cardiovascular system. Protein, as well as, antibodies directed against the protein may show utility as a tumor marker and/or immunotherapy targets for the above listed tumors and tissues.

Features of Protein Encoded by Gene No: 91

This gene maps to the chromosome X, and therefore, may be used as a marker in linkage analysis for chromosome X.

Preferred polypeptides of the invention comprise, or alternatively consist of, an amino acid sequence selected from the group:

CSVFPPSLWFYLPLVFDDGDVQ (SEQ ID NO: 523), GVSLPLLGDASQLGYLGVRDALEEAL-CLFSDVQLCAGRTSALFKAXRQGRLSLQRILLP-FVWLCPAPQRS LQRQAGLLELRWAPPSSS-FLAALFTPSSLGNGGRPSPSLTAXLQFDLRLLC (SEQ ID NO: 524), and/or VCRGFCCLLFGCALPPRGGVYR-GRQASLNCGGLHRVRVSWPLCLP-PQASAMVGAPPPASLPXCSLISDCCA SNX (SEQ ID NO: 525). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

This gene is expressed in spleen from chronic lymphocytic leukemia patients.

Polynucleotides and polypeptides of the invention are useful as reagents for differential identification of the tissue(s) or cell type(s) present in a biological sample and for diagnosis of diseases and conditions which include, but are not limited to, chronic lymphocytic leukemia, and other immune disorders, particularly proliferative diseases. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., immune, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in spleen from chronic lymphocytic leukemia patients indicates that polynucleotides and polypeptides corresponding to this gene are useful for the diagnosis and treatment of a variety of immune system disorders. Representative uses are described in the "Immune Activity" and "Infectious Disease" sections below, in Example 11, 13, 14, 16, 18, 19, 20, 32, 33, 34, 53, and 58, and elsewhere herein. Briefly, the expression of this gene product in leukemia cells indicates a role in the regulation of the proliferation; survival; differentiation; and/or activation of potentially all hematopoietic cell lineages, including blood stem cells. This gene product may be involved in the regulation of cytokine production, antigen presentation, or other processes that may also suggest a usefulness in the treatment of cancer e.g., by boosting immune responses. Expression in cells of lymphoid origin, the natural gene product may be involved in immune functions. Therefore it may be also used as an agent for immunological disorders including arthritis, asthma, immune deficiency diseases such as AIDS, and leukemia. In addition, this gene product may have commercial utility in the expansion of stem cells and committed progenitors of various blood lineages, and in the differentiation and/or proliferation of various cell types.

Furthermore, the protein may also be used to determine biological activity, raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 92

The translation product of this gene was shown to have homology to the human reverse transcriptase gene (See e.g., Genbank Accession No. gi|439877; all references available through this accession are hereby incorporated by reference herein).

Preferred polypeptides of the invention comprise, or alternatively consist of, an amino acid sequence selected from the group: MSHKHMRRSATSYIIRERQ IKIIVRYHYTPIMTT (SEQ ID NO: 526), IRERQIKIIVRYHYTP (SEQ ID NO: 527), KKTCTMFIATLFT (SEQ ID NO: 528), SVASVFI-PLKVSVTKQFIFF XFFFFLRRSLAPAWVAERXTSQET-KQNKKTPQLRGKVAHACDPITLGGRRW-
EVGESLEARSPS (SEQ ID NO: 530) and/or EKIFAKHLSVKGL (SEQ ID NO: 529). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

The gene encoding the disclosed cDNA is believed to reside on chromosome 22. Accordingly, polynucleotides related to this invention are useful as a marker in linkage analysis for chromosome 22.

This gene is expressed in microvascular endothelial cells.

Polynucleotides and polypeptides of the invention are useful as reagents for differential identification of the tissue(s) or cell type(s) present in a biological sample and for diagnosis of diseases and conditions which include, but are not limited to, various diseases of the cardiovascular and circulatory systems. Similarly, polypeptides and antibodies directed to these polypeptides are useful in providing immunological probes for differential identification of the tissue(s) or cell type(s). For a number of disorders of the above tissues or cells, particularly of the cardiovascular system, expression of this gene at significantly higher or lower levels may be routinely detected in certain tissues or cell types (e.g., vascular, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in microvascular endothelial cells combined with the homology to the conserved human gene for reverse transcriptase indicates that polynucleotides and polypeptides corresponding to this gene are useful for the diagnosis and treatment of cancer and other proliferative disorders, particularly vascular disorders. Representative uses are described in the "Immune Activity" and "Infectious Disease" sections below, in Example 11, 13, 14, 16, 18, 19, 20, 32, 33, 34, 53, and 58, and elsewhere herein. Alternatively expression within microvascular tissue, a tissue marked by proliferating cells, indicates that this protein may play a role in the regulation of cellular division. As such, this protein may play a role in the proliferation, differentiation, and/or survival of hematopoietic cell lineages. In such an event, this gene may be useful in the treatment of lymphoproliferative disorders, and in the maintenance and differentiation of various hematopoietic lineages from early hematopoietic stem and committed progenitor cells. Similarly, embryonic development also involves decisions involving cell differentiation and/or apoptosis in pattern formation. Thus this protein may also be involved in apoptosis or tissue differentiation and could again be useful in cancer therapy.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 93

The translation product of this gene shares sequence homology with the Y43F4B.5 protein from *Caenorhabditis elegans* (See Genebank Accession No. gn1|PID|e1247424 (AL021481)).

Moreover, the translation product also shares homology to phosphoglucomutase and phosphomannomutase proteins (See Genbank Accessions CAA16334.1 and CAA20128.1; all references available through this accession are hereby incorporated herein by reference). Based on the sequence similarity, the translation product of this gene is expected to share at least some biological activities with phosphoglucomutase proteins. Such activities are known in the art, some of which are described elsewhere herein.

Preferred polypeptides of the invention comprise, or alternatively consist of, an amino acid sequence selected from the group:

ARGKTVLFAFEEAIGYMCCPFVLD-
KDGVSAAVISAELASFLATKNLSLSQQL-
KAIYVEYGYHITKASYFICH DQETIKKLFENL-
RNYDGKNNYPKACGKFEISAIRDLTTGYDDSQPDKK-
AVLPTSKSSQMITFTFANGGVAT MRTSGTEP-
KIKYYAELCAPPGNSDPEQLKKELNELV-
SAIEEHFFQPQKYNLQPKAD (SEQ ID NO: 532), YMC-
CPFVLDKDGVSAAVISAELASFLATKNLSLSQQLKAI-
YVEYGYHITKASYFICHDQETIKKLFENLRNY DGKN-
NYPKACGKFEISAIRDLTTGYDDSQPDKKAVLPTS-
KSSQMITFTFANGGVATMRTSGTEPKIKYYAEL CAP-
PGNSDPEQLKKELNELVSAIEEHFFQPQKYNLQPKAD
(SEQ ID NO: 531), DKDGVSAAVISAELASFL (SEQ ID NO: 533), RDLTTGYDDSQPD (SEQ ID NO: 534), KAV-
LPTSKSSQMITF (SEQ ID NO: 535), and/or TMRTSGTEP-
KIKYYAEL (SEQ ID NO: 536). Moreover, fragments and variants of these polypeptides (such as, for example, fragments as described herein, polypeptides at least 80%, 85%, 90%, 95%, 96%, 97%, 98%, or 99% identical to these polypeptides and polypeptides encoded by the polynucleotide which hybridizes, under stringent conditions, to the polynucleotide encoding these polypeptides) are encompassed by the invention. Antibodies that bind polypeptides of the invention are also encompassed by the invention. Polynucleotides encoding these polypeptides are also encompassed by the invention.

The gene encoding the disclosed cDNA is believed to reside on chromosome 4. Accordingly, polynucleotides related to this invention are useful as a marker in linkage analysis for chromosome 4.

This gene is expressed in placenta, fetal spleen, and to a lesser extent in prostate, T-cells and neutophils.

Polynucleotides and polypeptides of the invention are useful as reagents for differential identification of the tissue(s) or cell type(s) present in a biological sample and for diagnosis of diseases and conditions which include, but are not limited to, various diseases of the immune and reproductive systems, including cancer. Similarly, polypeptides and antibodies directed to these polypeptides are useful in providing immunological probes for differential identification of the tissue(s) or cell type(s). For a number of disorders of the above tissues or cells, particularly of the immune and reproductive systems, expression of this gene at significantly higher or lower levels may be routinely detected in certain tissues or cell types (e.g., immune, reproductive, cancerous and wounded tissues) or bodily fluids (e.g., seminal fluid, lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Preferred polypeptides of the present invention comprise, or alternatively consist, of one or more immunogenic epitopes shown in SEQ ID NO: 226 as residues: Leu-23 to Met-30. Polynucleotides encoding said polypeptides are also encompassed by the invention.

The tissue distribution in fetal spleen indicates polynucleotides and polypeptides corresponding to this gene are useful for the diagnosis and treatment of a variety of immune system disorders. Representative uses are described in the "Immune Activity" and "Infectious Disease" sections below, in Example 11, 13, 14, 16, 18, 19, 20, 32, 33, 34, 53, and 58, and elsewhere herein. Briefly, the expression of this gene product indicates a role in regulating the proliferation; survival; differentiation; and/or activation of hematopoietic cell lineages, including blood stem cells. Involvement in the regulation of cytokine production, antigen presentation, or other processes suggests a usefulness in the treatment of cancer (e.g., by boosting immune responses). Expression in cells of lymphoid origin, the natural gene product would be involved in immune functions. Therefore it is also useful as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersensitivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus eiythematosis, drug induced hemolytic anemia, rheumatoid arthritis, Sjogren's disease, and scleroderma.

Moreover, the protein may represent a secreted factor that influences the differentiation or behavior of other blood cells, or that recruits hematopoietic cells to sites of injury. Thus, this gene product is thought to be useful in the expansion of stem cells and committed progenitors of various blood lineages, and in the differentiation and/or proliferation of various cell types.

Moreover, the protein is useful in the detection, treatment, and/or prevention of a variety of vascular disorders and conditions, which include, but are not limited to miscrovascular disease, vascular leak syndrome, aneurysm, stroke, embolism, thrombosis, coronary artery disease, arteriosclerosis, and/or atherosclerosis.

Furthermore, the protein may also be used to determine biological activity, to raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Features of Protein Encoded by Gene No: 94

This gene is expressed in activated monocytes.

Polynucleotides and polypeptides of the invention are useful as reagents for differential identification of the tissue(s) or cell type(s) present in a biological sample and for diagnosis of diseases and conditions which include, but are not limited to, various diseases and/or disorders of the immune system. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues or cell types (e.g., immune, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distribution in activated monocytes indicates polynucleotides and polypeptides corresponding to this gene are useful for the diagnosis and treatment of a variety of immune system disorders. Representative uses are described in the "Immune Activity" and "Infectious Disease" sections below, in Example 11, 13, 14, 16, 18, 19, 20, 32, 33, 34, 53, and 58, and elsewhere herein. Briefly, the expression of this gene product indicates a role in regulating the proliferation; survival; differentiation; and/or activation of hematopoietic cell lineages, including blood stem cells. Involvement in the regulation of cytokine production, antigen presentation, or other processes suggests a usefulness in the treatment of cancer (e.g. by boosting immune responses). Expression in cells of lymphoid origin, the natural gene product would be involved in immune functions. Therefore it is also useful as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersensitivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus erythematosis, drug induced hemolytic anemia, rheumatoid arthritis, Sjogren's disease, and scleroderma.

Moreover, the protein may represent a secreted factor that influences the differentiation or behavior of other blood cells, or that recruits hematopoietic cells to sites of injury. Thus, this gene product is thought to be useful in the expansion of stem cells and committed progenitors of various blood lineages, and in the differentiation and/or proliferation of various cell types.

Furthermore, the protein may also be used to determine biological activity, raise antibodies, as tissue markers, to isolate cognate ligands or receptors, to identify agents that modulate their interactions, in addition to its use as a nutritional supplement. Protein, as well as, antibodies directed against the protein may show utility as a tumor marker and/or immunotherapy targets for the above listed tissues.

Lengthy table referenced here

US07838636-20101123-T00001

Please refer to the end of the specification for access instructions.

Lengthy table referenced here

US07838636-20101123-T00002

Please refer to the end of the specification for access instructions.

Lengthy table referenced here

US07838636-20101123-T00003

Please refer to the end of the specification for access instructions.

Lengthy table referenced here

US07838636-20101123-T00004

Please refer to the end of the specification for access instructions.

Lengthy table referenced here

US07838636-20101123-T00005

Please refer to the end of the specification for access instructions.

Lengthy table referenced here

US07838636-20101123-T00006

Please refer to the end of the specification for access instructions.

Lengthy table referenced here

US07838636-20101123-T00007

Please refer to the end of the specification for access instructions.

Lengthy table referenced here

US07838636-20101123-T00008

Please refer to the end of the specification for access instructions.

The polypeptides of the invention can be prepared in any suitable manner. Such polypeptides include isolated naturally occurring polypeptides, recombinantly produced polypeptides, synthetically produced polypeptides, or polypeptides produced by a combination of these methods. Means for preparing such polypeptides are well understood in the art.

The polypeptides may be in the form of the secreted protein, including the mature form, or may be a part of a larger protein, such as a fusion protein (see below). It is often advantageous to include an additional amino acid sequence which contains secretory or leader sequences, pro-sequences, sequences which aid in purification, such as multiple histidine residues, or an additional sequence for stability during recombinant production.

The polypeptides of the present invention are preferably provided in an isolated form, and preferably are substantially purified. A recombinantly produced version of a polypeptide, including the secreted polypeptide, can be substantially purified using techniques described herein or otherwise known in the art, such as, for example, by the one-step method described in Smith and Johnson, Gene 67:31-40 (1988). Polypeptides of the invention also can be purified from natural, synthetic or recombinant sources using techniques described herein or otherwise known in the art, such as, for example, antibodies of the invention raised against the secreted protein.

The present invention provides a polynucleotide comprising, or alternatively consisting of, the nucleic acid sequence of SEQ ID NO:X, and/or a cDNA contained in ATCC Deposit NO:Z. The present invention also provides a polypeptide comprising, or alternatively, consisting of, the polypeptide sequence of SEQ ID NO:Y and/or a polypeptide encoded by the cDNA contained in ATCC Deposit NO:Z. Polynucleotides encoding a polypeptide comprising, or alternatively consisting of the polypeptide sequence of SEQ ID NO:Y and/or a polypeptide sequence encoded by the cDNA contained in ATCC Deposit NO:Z are also encompassed by the invention.

Signal Sequences

The present invention also encompasses mature forms of the polypeptide having the polypeptide sequence of SEQ ID NO:Y and/or the polypeptide sequence encoded by the cDNA in a deposited clone. Polynucleotides encoding the mature forms (such as, for example, the polynucleotide sequence in SEQ ID NO:X and/or the polynucleotide sequence contained in the cDNA of a deposited clone) are also encompassed by the invention. According to the signal hypothesis, proteins secreted by mammalian cells have a signal or secretary leader sequence which is cleaved from the mature protein once export of the growing protein chain across the rough endoplasmic reticulum has been initiated. Most mammalian cells and even insect cells cleave secreted proteins with the same specificity. However, in some cases, cleavage of a secreted protein is not entirely uniform, which results in two or more mature species of the protein. Further, it has long been known that cleavage specificity of a secreted protein is ultimately determined by the primary structure of the complete protein, that is, it is inherent in the amino acid sequence of the polypeptide.

Methods for predicting whether a protein has a signal sequence, as well as the cleavage point for that sequence, are available. For instance, the method of McGeoch, Virus Res. 3:271-286 (1985), uses the information from a short N-terminal charged region and a subsequent uncharged region of the complete (uncleaved) protein. The method of von Heinje, Nucleic Acids Res. 14:4683-4690 (1986) uses the information from the residues surrounding the cleavage site, typically residues −13 to +2, where +1 indicates the amino terminus of the secreted protein. The accuracy of predicting the cleavage points of known mammalian secretory proteins for each of these methods is in the range of 75-80% (von Heinje, supra). However, the two methods do not always produce the same predicted cleavage point(s) for a given protein.

In the present case, the deduced amino acid sequence of the secreted polypeptide was analyzed by a computer program called SignalP (Henrik Nielsen et al., Protein Engineering 10:1-6 (1997)), which predicts the cellular location of a protein based on the amino acid sequence. As part of this computational prediction of localization, the methods of McGeoch and von Heinje are incorporated. The analysis of the amino acid sequences of the secreted proteins described herein by this program provided the results shown in Table 1A.

As one of ordinary skill would appreciate, however, cleavage sites sometimes vary from organism to organism and cannot be predicted with absolute certainty. Accordingly, the present invention provides secreted polypeptides having a sequence shown in SEQ ID NO:Y which have an N-terminus beginning within 5 residues (i.e., + or −5 residues) of the predicted cleavage point. Similarly, it is also recognized that in some cases, cleavage of the signal sequence from a secreted protein is not entirely uniform, resulting in more than one secreted species. These polypeptides, and the polynucleotides encoding such polypeptides, are contemplated by the present invention.

Moreover, the signal sequence identified by the above analysis may not necessarily predict the naturally occurring signal sequence. For example, the naturally occurring signal sequence may be further upstream from the predicted signal sequence. However, it is likely that the predicted signal sequence will be capable of directing the secreted protein to the ER. Nonetheless, the present invention provides the mature protein produced by expression of the polynucleotide sequence of SEQ ID NO:X and/or the polynucleotide sequence contained in the cDNA of a deposited clone, in a mammalian cell (e.g., COS cells, as described below). These polypeptides, and the polynucleotides encoding such polypeptides, are contemplated by the present invention.

Polynucleotide and Polypeptide Variants

The present invention is directed to variants of the polynucleotide sequence disclosed in SEQ ID NO:X, the complementary strand thereto, and/or the cDNA sequence contained in a deposited clone.

The present invention also encompasses variants of the polypeptide sequence disclosed in SEQ ID NO:Y and/or encoded by a deposited clone.

"Variant" refers to a polynucleotide or polypeptide differing from the polynucleotide or polypeptide of the present invention, but retaining essential properties thereof. Generally, variants are overall closely similar, and, in many regions, identical to the polynucleotide or polypeptide of the present invention.

The present invention is also directed to nucleic acid molecules which comprise, or alternatively consist of, a nucleotide sequence which is at least 80%, 85%, 90%, 95%, 96%, 97%, 98% or 99% identical to, for example, the nucleotide coding sequence in SEQ ID NO:X or the complementary strand thereto, the nucleotide coding sequence contained in a deposited cDNA clone or the complementary strand thereto, a nucleotide sequence encoding the polypeptide of SEQ ID NO:Y, a nucleotide sequence encoding the polypeptide encoded by the cDNA contained in a deposited clone, and/or polynucleotide fragments of any of these nucleic acid molecules (e.g., those fragments described herein). Polynucleotides which hybridize to these nucleic acid molecules under stringent hybridization conditions or lower stringency conditions are also encompassed by the invention, as are polypeptides encoded by these polynucleotides.

The present invention is also directed to polypeptides which comprise, or alternatively consist of, an amino acid sequence which is at least 80%, 85%, 90%, 95%, 96%, 97%, 98%, 99% identical to, for example, the polypeptide sequence shown in SEQ ID NO:Y, the polypeptide sequence encoded by the cDNA contained in a deposited clone, and/or polypeptide fragments of any of these polypeptides (e.g., those fragments described herein).

By a nucleic acid having a nucleotide sequence at least, for example, 95% "identical" to a reference nucleotide sequence of the present invention, it is intended that the nucleotide sequence of the nucleic acid is identical to the reference sequence except that the nucleotide sequence may include up to five point mutations per each 100 nucleotides of the reference nucleotide sequence encoding the polypeptide. In other words, to obtain a nucleic acid having a nucleotide sequence at least 95% identical to a reference nucleotide sequence, up to 5% of the nucleotides in the reference sequence may be deleted or substituted with another nucleotide, or a number of nucleotides up to 5% of the total nucleotides in the reference sequence may be inserted into the reference sequence. The query sequence may be an entire sequence shown in Table 1A, the ORF (open reading frame), or any fragment specified as described herein.

As a practical matter, whether any particular nucleic acid molecule or polypeptide is at least 80%, 85%, 90%, 95%, 96%, 97%, 98% or 99% identical to a nucleotide sequence of the presence invention can be determined conventionally using known computer programs. A preferred method for determining the best overall match between a query sequence (a sequence of the present invention) and a subject sequence, also referred to as a global sequence alignment, can be determined using the FASTDB computer program based on the algorithm of Brutlag et al. (Comp. App. Biosci. 6:237-245 (1990)). In a sequence alignment the query and subject sequences are both DNA sequences. An RNA sequence can be compared by converting U' s to T' s. The result of said global sequence alignment is in percent identity. Preferred parameters used in a FASTDB alignment of DNA sequences to calculate percent identity are: Matrix=Unitary, k-tuple=4, Mismatch Penalty=1, Joining Penalty=30, Randomization Group Length=0, Cutoff Score=1, Gap Penalty=5, Gap Size Penalty 0.05, Window Size=500 or the length of the subject nucleotide sequence, whichever is shorter.

If the subject sequence is shorter than the query sequence because of 5' or 3' deletions, not because of internal deletions, a manual correction must be made to the results. This is because the FASTDB program does not account for 5' and 3' truncations of the subject sequence when calculating percent identity. For subject sequences truncated at the 5' or 3' ends, relative to the query sequence, the percent identity is corrected by calculating the number of bases of the query sequence that are 5' and 3' of the subject sequence, which are not matched/aligned, as a percent of the total bases of the query sequence. Whether a nucleotide is matched/aligned is determined by results of the FASTDB sequence alignment. This percentage is then subtracted from the percent identity, calculated by the above FASTDB program using the specified parameters, to arrive at a final percent identity score. This corrected score is what is used for the purposes of the present invention. Only bases outside the 5' and 3' bases of the subject sequence, as displayed by the FASTDB alignment, which are not matched/aligned with the query sequence, are calculated for the purposes of manually adjusting the percent identity score.

For example, a 90 base subject sequence is aligned to a 100 base query sequence to determine percent identity. The deletions occur at the 5' end of the subject sequence and therefore, the FASTDB alignment does not show a matched/alignment of the first 10 bases at 5' end. The 10 unpaired bases represent 10% of the sequence (number of bases at the 5' and 3' ends not matched/total number of bases in the query sequence) so 10% is subtracted from the percent identity score calculated by the FASTDB program. If the remaining 90 bases were perfectly matched the final percent identity would be 90%. In another example, a 90 base subject sequence is compared with a 100 base query sequence. This time the deletions are internal deletions so that there are no bases on the 5' or 3' of the subject sequence which are not matched/aligned with the query. In this case the percent identity calculated by FASTDB is not manually corrected. Once again, only bases 5' and 3' of the subject sequence which are not matched/aligned with the query sequence are manually corrected for. No other manual corrections are to made for the purposes of the present invention.

By a polypeptide having an amino acid sequence at least, for example, 95% "identical" to a query amino acid sequence of the present invention, it is intended that the amino acid sequence of the subject polypeptide is identical to the query sequence except that the subject polypeptide sequence may include up to five amino acid alterations per each 100 amino acids of the query amino acid sequence. In other words, to obtain a polypeptide having an amino acid sequence at least 95% identical to a query amino acid sequence, up to 5% of the amino acid residues in the subject sequence may be inserted, deleted, (indels) or substituted with another amino acid. These alterations of the reference sequence may occur at the amino or carboxy terminal positions of the reference amino acid sequence or anywhere between those terminal positions, interspersed either individually among residues in the reference sequence or in one or more contiguous groups within the reference sequence.

As a practical matter, whether any particular polypeptide is at least 80%, 85%, 90%, 95%, 96%, 97%, 98% or 99% identical to, for instance, an amino acid sequences shown in Table 1A (SEQ ID NO:Y) or to the amino acid sequence encoded by cDNA contained in a deposited clone can be determined conventionally using known computer programs. A preferred method for determining the best overall match between a query sequence (a sequence of the present invention) and a subject sequence, also referred to as a global sequence alignment, can be determined using the FASTDB computer program based on the algorithm of Brutlag et al. (Comp. App. Biosci. 6:237-245 (1990)). In a sequence alignment the query and subject sequences are either both nucleotide sequences or both amino acid sequences. The result of said global sequence alignment is in percent identity. Preferred parameters used in a FASTDB amino acid alignment are: Matrix=PAM 0, k-tuple=2, Mismatch Penalty=1, Joining Penalty=20, Randomization Group Length=0, Cutoff Score=1, Window Size=sequence length, Gap Penalty=5, Gap Size Penalty=0.05, Window Size=500 or the length of the subject amino acid sequence, whichever is shorter.

If the subject sequence is shorter than the query sequence due to N- or C-terminal deletions, not because of internal deletions, a manual correction must be made to the results. This is because the FASTDB program does not account for N- and C-terminal truncations of the subject sequence when calculating global percent identity. For subject sequences truncated at the N- and C-termini, relative to the query sequence, the percent identity is corrected by calculating the number of residues of the query sequence that are N- and C-terminal of the subject sequence, which are not matched/aligned with a corresponding subject residue, as a percent of the total bases of the query sequence. Whether a residue is matched/aligned is determined by results of the FASTDB sequence alignment. This percentage is then subtracted from the percent identity, calculated by the above FASTDB program using the specified parameters, to arrive at a final percent identity score. This final percent identity score is what is used for the purposes of the present invention. Only residues to the N- and C-termini of the subject sequence, which are not matched/aligned with the query sequence, are considered for the purposes of manually adjusting the percent identity score. That is, only query residue positions outside the farthest N- and C-terminal residues of the subject sequence.

For example, a 90 amino acid residue subject sequence is aligned with a 100 residue query sequence to determine percent identity. The deletion occurs at the N-terminus of the subject sequence and therefore, the FASTDB alignment does not show a matching/alignment of the first 10 residues at the N-terminus. The 10 unpaired residues represent 10% of the sequence (number of residues at the N- and C-termini not matched/total number of residues in the query sequence) so 10% is subtracted from the percent identity score calculated by the FASTDB program. If the remaining 90 residues were perfectly matched the final percent identity would be 90%. In another example, a 90 residue subject sequence is compared with a 100 residue query sequence. This time the deletions are internal deletions so there are no residues at the N- or C-termini of the subject sequence which are not matched/aligned with the query. In this case the percent identity calculated by FASTDB is not manually corrected. Once again, only residue positions outside the N- and C-terminal ends of the subject sequence, as displayed in the FASTDB alignment, which are not matched/aligned with the query sequence are manually corrected for. No other manual corrections are to made for the purposes of the present invention.

The variants may contain alterations in the coding regions, non-coding regions, or both. Especially preferred are polynucleotide variants containing alterations which produce silent substitutions, additions, or deletions, but do not alter the properties or activities of the encoded polypeptide. Nucleotide variants produced by silent substitutions due to the degeneracy of the genetic code are preferred. Moreover, variants in which 5-10, 1-5, or 1-2 amino acids are substituted, deleted, or added in any combination are also preferred. Polynucleotide variants can be produced for a variety of reasons, e.g., to optimize codon expression for a particular host (change codons in the human mRNA to those preferred by a bacterial host such as E. coli).

Naturally occurring variants are called "allelic variants," and refer to one of several alternate forms of a gene occupying a given locus on a chromosome of an organism. (Genes II, Lewin, B., ed., John Wiley & Sons, New York (1985).) These allelic variants can vary at either the polynucleotide and/or polypeptide level and are included in the present invention. Alternatively, non-naturally occurring variants may be produced by mutagenesis techniques or by direct synthesis.

Using known methods of protein engineering and recombinant DNA technology, variants may be generated to improve or alter the characteristics of the polypeptides of the present invention. For instance, one or more amino acids can be deleted from the N-terminus or C-terminus of the secreted protein without substantial loss of biological function. The authors of Ron et al., J. Biol. Chem. 268: 2984-2988 (1993), reported variant KGF proteins having heparin binding activity even after deleting 3, 8, or 27 amino-terminal amino acid residues. Similarly, Interferon gamma exhibited up to ten times higher activity after deleting 8-10 amino acid residues from the carboxy terminus of this protein. (Dobeli et al., J. Biotechnology 7:199-216 (1988).)

Moreover, ample evidence demonstrates that variants often retain a biological activity similar to that of the naturally occurring protein. For example, Gayle and coworkers (J. Biol. Chem. 268:22105-22111 (1993)) conducted extensive mutational analysis of human cytokine IL-1a. They used random mutagenesis to generate over 3,500 individual IL-1a mutants that averaged 2.5 amino acid changes per variant over the entire length of the molecule. Multiple mutations were examined at every possible amino acid position. The investigators found that "[m]ost of the molecule could be altered with little effect on either [binding or biological activity]." (See, Abstract.) In fact, only 23 unique amino acid sequences, out of more than 3,500 nucleotide sequences examined, produced a protein that significantly differed in activity from wild-type.

Furthermore, even if deleting one or more amino acids from the N-terminus or C-terminus of a polypeptide results in modification or loss of one or more biological functions, other biological activities may still be retained. For example, the ability of a deletion variant to induce and/or to bind antibodies which recognize the secreted form will likely be retained when less than the majority of the residues of the secreted form are removed from the N-terminus or C-terminus. Whether a particular polypeptide lacking N- or C-terminal residues of a protein retains such immunogenic activities can readily be determined by routine methods described herein and otherwise known in the art.

Thus, the invention further includes polypeptide variants which show substantial biological activity. Such variants include deletions, insertions, inversions, repeats, and substitutions selected according to general rules known in the art so as have little effect on activity. For example, guidance concerning how to make phenotypically silent amino acid substitutions is provided in Bowie et al., Science 247:1306-1310 (1990), wherein the authors indicate that there are two main strategies for studying the tolerance of an amino acid sequence to change.

The first strategy exploits the tolerance of amino acid substitutions by natural selection during the process of evolution. By comparing amino acid sequences in different species, conserved amino acids can be identified. These conserved amino acids are likely important for protein function. In contrast, the amino acid positions where substitutions have been tolerated by natural selection indicates that these positions are not critical for protein function. Thus, positions tolerating amino acid substitution could be modified while still maintaining biological activity of the protein.

The second strategy uses genetic engineering to introduce amino acid changes at specific positions of a cloned gene to identify regions critical for protein function. For example, site directed mutagenesis or alanine-scanning mutagenesis (introduction of single alanine mutations at every residue in the molecule) can be used. (Cunningham and Wells, Science 244:1081-1085 (1989).) The resulting mutant molecules can then be tested for biological activity.

As the authors state, these two strategies have revealed that proteins are surprisingly tolerant of amino acid substitutions. The authors further indicate which amino acid changes are likely to be permissive at certain amino acid positions in the protein. For example, most buried (within the tertiary structure of the protein) amino acid residues require nonpolar side chains, whereas few features of surface side chains are generally conserved. Moreover, tolerated conservative amino acid substitutions involve replacement of the aliphatic or hydrophobic amino acids Ala, Val, Leu and Ile; replacement of the hydroxyl residues Ser and Thr; replacement of the acidic residues Asp and Glu; replacement of the amide residues Asn and Gln, replacement of the basic residues Lys, Arg, and His; replacement of the aromatic residues Phe, Tyr, and Trp, and replacement of the small-sized amino acids Ala, Ser, Thr, Met, and Gly.

Besides conservative amino acid substitution, variants of the present invention include (i) substitutions with one or more of the non-conserved amino acid residues, where the substituted amino acid residues may or may not be one encoded by the genetic code, or (ii) substitution with one or more of amino acid residues having a substituent group, or (iii) fusion of the mature polypeptide with another compound, such as a compound to increase the stability and/or solubility of the polypeptide (for example, polyethylene glycol), or (iv) fusion of the polypeptide with additional amino acids, such as, for example, an IgG Fc fusion region peptide, or leader or secretory sequence, or a sequence facilitating purification or (v) fusion of the polypeptide with another compound, such as albumin (including, but not limited to, recombinant albumin (see, e.g., U.S. Pat. No. 5,876,969, issued Mar. 2, 1999, EP Patent 0 413 622, and U.S. Pat. No. 5,766,883, issued Jun. 16, 1998, herein incorporated by reference in their entirety)). Such variant polypeptides are deemed to be within the scope of those skilled in the art from the teachings herein.

For example, polypeptide variants containing amino acid substitutions of charged amino acids with other charged or neutral amino acids may produce proteins with improved characteristics, such as less aggregation. Aggregation of pharmaceutical formulations both reduces activity and increases clearance due to the aggregate's immunogenic activity. (Pinckard et al., Clin. Exp. Immunol 2131-340 (1967); Robbins et al., Diabetes 36: 838-845 (1987); Cleland et al., Crit. Rev. Therapeutic Drug Carrier Systems 10:307-377 (1993).)

A further embodiment of the invention relates to a polypeptide which comprises the amino acid sequence of the present invention having an amino acid sequence which contains at least one amino acid substitution, but not more than 50 amino acid substitutions, even more preferably, not more than 40 amino acid substitutions, still more preferably, not more than 30 amino acid substitutions, and still even more preferably, not more than 20 amino acid substitutions. Of course, in order of ever-increasing preference, it is highly preferable for a peptide or polypeptide to have an amino acid sequence which comprises the amino acid sequence of the present invention, which contains at least one, but not more than 10, 9, 8, 7, 6, 5, 4, 3, 2 or 1 amino acid substitutions. In specific embodiments, the number of additions, substitutions, and/or deletions in the amino acid sequence of the present invention or fragments thereof (e.g., the mature form and/or other fragments described herein), is 1-5, 5-10, 5-25, 5-50, 10-50 or 50-150, conservative amino acid substitutions are preferable.

Polynucleotide and Polypeptide Fragments

The present invention is also directed to polynucleotide fragments of the polynucleotides of the invention.

In the present invention, a "polynucleotide fragment" refers to a short polynucleotide having a nucleic acid sequence which: is a portion of that contained in a deposited clone, or encoding the polypeptide encoded by the cDNA in a deposited clone; is a portion of that shown in SEQ ID NO:X or the complementary strand thereto, or is a portion of a polynucleotide sequence encoding the polypeptide of SEQ ID NO:Y. The nucleotide fragments of the invention are preferably at least about 15 nt, and more preferably at least about 20 nt, still more preferably at least about 30 nt, and even more preferably, at least about 40 nt, at least about 50 nt, at least about 75 nt, or at least about 150 nt in length. A fragment "at least 20 nt in length," for example, is intended to include 20 or more contiguous bases from the cDNA sequence contained in a deposited clone or the nucleotide sequence shown in SEQ ID NO:X. In this context "about" includes the particularly recited value, a value larger or smaller by several (5, 4, 3, 2, or 1) nucleotides, at either terminus or at both termini. These nucleotide fragments have uses that include, but are not limited to, as diagnostic probes and primers as discussed herein. Of course, larger fragments (e.g., 50, 150, 500, 600, 2000 nucleotides) are preferred.

Moreover, representative examples of polynucleotide fragments of the invention, include, for example, fragments comprising, or alternatively consisting of, a sequence from about nucleotide number 1-50, 51-100, 101-150, 151-200, 201-250, 251-300, 301-350, 351-400, 401-450, 451-500, 501-550, 551-600, 651-700, 701-750, 751-800, 800-850, 851-900, 901-950, 951-1000, 1001-1050, 1051-1100, 1101-1150, 1151-1200, 1201-1250, 1251-1300, 1301-1350, 1351-1400, 1401-1450, 1451-1500, 1501-1550, 1551-1600, 1601-1650, 1651-1700, 1701-1750, 1751-1800, 1801-1850, 1851-1900, 1901-1950, 1951-2000, or 2001 to the end of SEQ ID NO:X, or the complementary strand thereto, or the cDNA contained in a deposited clone. In this context "about" includes the particularly recited ranges, and ranges larger or smaller by several (5, 4, 3, 2, or 1) nucleotides, at either terminus or at both termini. Preferably, these fragments encode a polypeptide which has biological activity. More preferably, these polynucleotides can be used as probes or primers as discussed herein. Polynucleotides which hybridize to these nucleic acid molecules under stringent hybridization conditions or lower stringency conditions are also encompassed by the invention, as are polypeptides encoded by these polynucleotides.

In the present invention, a "polypeptide fragment" refers to an amino acid sequence which is a portion of that contained in SEQ ID NO:Y or encoded by the cDNA contained in a deposited clone. Protein (polypeptide) fragments may be "free-standing," or comprised within a larger polypeptide of which the fragment forms a part or region, most preferably as a single continuous region. Representative examples of polypeptide fragments of the invention, include, for example, fragments comprising, or alternatively consisting of, from about amino acid number 1-20, 21-40, 41-60, 61-80, 81-100, 102-120, 121-140, 141-160, or 161 to the end of the coding region. Moreover, polypeptide fragments can be about 20, 30, 40, 50, 60, 70, 80, 90, 100, 110, 120, 130, 140, or 150 amino acids in length. In this context "about" includes the particularly recited ranges or values, and ranges or values larger or smaller by several (5, 4, 3, 2, or 1) amino acids, at either extreme or at both extremes. Polynucleotides encoding these polypeptides are also encompassed by the invention.

Preferred polypeptide fragments include the secreted protein as well as the mature form. Further preferred polypeptide fragments include the secreted protein or the mature form having a continuous series of deleted residues from the amino or the carboxy terminus, or both. For example, any number of amino acids, ranging from 1-60, can be deleted from the amino terminus of either the secreted polypeptide or the mature form. Similarly, any number of amino acids, ranging from 1-30, can be deleted from the carboxy terminus of the secreted protein or mature form. Furthermore, any combination of the above amino and carboxy terminus deletions are preferred. Similarly, polynucleotides encoding these polypeptide fragments are also preferred.

Also preferred are polypeptide and polynucleotide fragments characterized by structural or functional domains, such as fragments that comprise alpha-helix and alpha-helix forming regions, beta-sheet and beta-sheet-forming regions, turn and turn-forming regions, coil and coil-forming regions, hydrophilic regions, hydrophobic regions, alpha amphipathic regions, beta amphipathic regions, flexible regions, surface-forming regions, substrate binding region, and high antigenic index regions. Polypeptide fragments of SEQ ID NO:Y falling within conserved domains are specifically contemplated by the present invention. Moreover, polynucleotides encoding these domains are also contemplated.

Other preferred polypeptide fragments are biologically active fragments. Biologically active fragments are those exhibiting activity similar, but not necessarily identical, to an activity of the polypeptide of the present invention. The biological activity of the fragments may include an improved desired activity, or a decreased undesirable activity. Polynucleotides encoding these polypeptide fragments are also encompassed by the invention.

Preferably, the polynucleotide fragments of the invention encode a polypeptide which demonstrates a functional activity. By a polypeptide demonstrating a "functional activity" is meant, a polypeptide capable of displaying one or more known functional activities associated with a full-length (complete) polypeptide of invention protein. Such functional activities include, but are not limited to, biological activity, antigenicity [ability to bind (or compete with a polypeptide of the invention for binding) to an antibody to the polypeptide of the invention], immunogenicity (ability to generate antibody which binds to a polypeptide of the invention), ability to form multimers with polypeptides of the invention, and ability to bind to a receptor or ligand for a polypeptide of the invention.

The functional activity of polypeptides of the invention, and fragments, variants derivatives, and analogs thereof, can be assayed by various methods.

For example, in one embodiment where one is assaying for the ability to bind or compete with full-length polypeptide of the invention for binding to an antibody of the polypeptide of the invention, various immunoassays known in the art can be used, including but not limited to, competitive and non-competitive assay systems using techniques such as radioimmunoassays, ELISA (enzyme linked immunosorbent assay), "sandwich" immunoassays, immunoradiometric assays, gel diffusion precipitation reactions, immunodiffusion assays, in situ immunoassays (using colloidal gold, enzyme or radioisotope labels, for example), western blots, precipitation reactions, agglutination assays (e.g., gel agglutination assays, hemagglutination assays), complement fixation assays, immunofluorescence assays, protein A assays, and immunoelectrophoresis assays, etc. In one embodiment, antibody binding is detected by detecting a label on the primary antibody. In another embodiment, the primary antibody is detected by detecting binding of a secondary antibody or reagent to the primary antibody. In a further embodiment, the secondary antibody is labeled. Many means are known in the art for detecting binding in an immunoassay and are within the scope of the present invention.

In another embodiment, where a ligand for a polypeptide of the invention identified, or the ability of a polypeptide fragment, variant or derivative of the invention to multimerize is being evaluated, binding can be assayed, e.g., by means well-known in the art, such as, for example, reducing and non-reducing gel chromatography, protein affinity chromatography, and affinity blotting. See generally, Phizicky, E., et al., 1995, Microbiol. Rev. 59:94-123. In another embodiment, physiological correlates of binding of a polypeptide of the invention to its substrates (signal transduction) can be assayed.

In addition, assays described herein (see Examples) and otherwise known in the art may routinely be applied to measure the ability of polypeptides of the invention and fragments, variants derivatives and analogs thereof to elicit related biological activity related to that of the polypeptide of the invention (either in vitro or in vivo). Other methods will be known to the skilled artisan and are within the scope of the invention.

Epitopes and Antibodies

The present invention encompasses polypeptides comprising, or alternatively consisting of, an epitope of the polypeptide having an amino acid sequence of SEQ ID NO:Y, or an epitope of the polypeptide sequence encoded by a polynucleotide sequence contained in ATCC Deposit NO:Z or encoded by a polynucleotide that hybridizes to the complement of the sequence of SEQ ID NO:X or contained in ATCC Deposit NO:Z under stringent hybridization conditions or lower stringency hybridization conditions as defined supra. The present invention further encompasses polynucleotide sequences encoding an epitope of a polypeptide sequence of the invention (such as, for example, the sequence disclosed in SEQ ID NO:X), polynucleotide sequences of the complementary strand of a polynucleotide sequence encoding an epitope of the invention, and polynucleotide sequences which hybridize to the complementary strand under stringent hybridization conditions or lower stringency hybridization conditions defined supra.

The term "epitopes," as used herein, refers to portions of a polypeptide having antigenic or immunogenic activity in an animal, preferably a mammal, and most preferably in a human. In a preferred embodiment, the present invention encompasses a polypeptide comprising an epitope, as well as the polynucleotide encoding this polypeptide. An "immunogenic epitope," as used herein, is defined as a portion of a protein that elicits an antibody response in an animal, as determined by any method known in the art, for example, by the methods for generating antibodies described infra. (See, for example, Geysen et al., Proc. Natl. Acad. Sci. USA 81:3998-4002 (1983)). The term "antigenic epitope," as used herein, is defined as a portion of a protein to which an antibody can immunospecifically bind its antigen as determined by any method well known in the art, for example, by the immunoassays described herein Immunospecific binding excludes non-specific binding but does not necessarily exclude cross-reactivity with other antigens. Antigenic epitopes need not necessarily be immunogenic.

Fragments which function as epitopes may be produced by any conventional means. (See, e.g., Houghten, Proc. Natl. Acad. Sci. USA 82:5131-5135 (1985), further described in U.S. Pat. No. 4,631,211).

In the present invention, antigenic epitopes preferably contain a sequence of at least 4, at least 5, at least 6, at least 7, more preferably at least 8, at least 9, at least 10, at least 11, at least 12, at least 13, at least 14, at least 15, at least 20, at least 25, at least 30, at least 40, at least 50, and, most preferably, between about 15 to about 30 amino acids. Preferred polypeptides comprising immunogenic or antigenic epitopes are at least 10, 15, 20, 25, 30, 35, 40, 45, 50, 55, 60, 65, 70, 75, 80, 85, 90, 95, or 100 amino acid residues in length. Additional non-exclusive preferred antigenic epitopes include the antigenic epitopes disclosed herein, as well as portions thereof. Antigenic epitopes are useful, for example, to raise antibodies, including monoclonal antibodies, that specifically bind the epitope. Preferred antigenic epitopes include the antigenic epitopes disclosed herein, as well as any combination of two, three, four, five or more of these antigenic epitopes. Antigenic epitopes can be used as the target molecules in immunoassays. (See, for instance, Wilson et al., Cell 37:767-778 (1984); Sutcliffe et al., Science 219:660-666 (1983)).

Similarly, immunogenic epitopes can be used, for example, to induce antibodies according to methods well known in the art. (See, for instance, Sutcliffe et al., supra; Wilson et al., supra; Chow et al., Proc. Natl. Acad. Sci. USA 82:910-914; and Bittle et al., J. Gen. Virol. 66:2347-2354 (1985). Preferred immunogenic epitopes include the immunogenic epitopes disclosed herein, as well as any combination of two, three, four, five or more of these immunogenic epitopes. The polypeptides comprising one or more immunogenic epitopes may be presented for eliciting an antibody response together with a carrier protein, such as an albumin, to an animal system (such as rabbit or mouse), or, if the polypeptide is of sufficient length (at least about 25 amino acids), the polypeptide may be presented without a carrier. However, immunogenic epitopes comprising as few as 8 to 10 amino acids have been shown to be sufficient to raise antibodies capable of binding to, at the very least, linear epitopes in a denatured polypeptide (e.g., in Western blotting).

Epitope-bearing polypeptides of the present invention may be used to induce antibodies according to methods well known in the art including, but not limited to, in vivo immunization, in vitro immunization, and phage display methods. See, e.g., Sutcliffe et al., supra; Wilson et al., supra, and Bittle et al., J. Gen. Virol., 66:2347-2354 (1985). If in vivo immunization is used, animals may be immunized with free peptide; however, anti-peptide antibody titer may be boosted by coupling the peptide to a macromolecular carrier, such as keyhole limpet hemacyanin (KLH) or tetanus toxoid. For instance, peptides containing cysteine residues may be coupled to a carrier using a linker such as maleimidobenzoyl-N-hydroxysuccinimide ester (MBS), while other peptides may be coupled to carriers using a more general linking agent such as glutaraldehyde Animals such as rabbits, rats and mice are immunized with either free or carrier-coupled peptides, for instance, by intraperitoneal and/or intradermal injection of emulsions containing about 100 μg of peptide or carrier protein and Freund's adjuvant or any other adjuvant known for stimulating an immune response. Several booster injections may be needed, for instance, at intervals of about two weeks, to provide a useful titer of anti-peptide antibody which can be detected, for example, by ELISA assay using free peptide adsorbed to a solid surface. The titer of anti-peptide antibodies in serum from an immunized animal may be increased by selection of anti-peptide antibodies, for instance, by adsorption to the peptide on a solid support and elution of the selected antibodies according to methods well known in the art.

As one of skill in the art will appreciate, and as discussed above, the polypeptides of the present invention (e.g., those comprising an immunogenic or antigenic epitope) can be fused to heterologous polypeptide sequences. For example, polypeptides of the present invention (including fragments or variants thereof), may be fused with the constant domain of immunoglobulins (IgA, IgE, IgG, IgM), or portions thereof (CH1, CH2, CH3, or any combination thereof and portions thereof, resulting in chimeric polypeptides. By way of another non-limiting example, polypeptides and/or antibodies of the present invention (including fragments or variants thereof) may be fused with albumin (including but not limited to recombinant human serum albumin or fragments or variants thereof (see, e.g., U.S. Pat. No. 5,876,969, issued Mar. 2, 1999, EP Patent 0 413 622, and U.S. Pat. No. 5,766,883, issued Jun. 16, 1998, herein incorporated by reference in their entirety)). In a preferred embodiment, polypeptides and/or antibodies of the present invention (including fragments or variants thereof) are fused with the mature form of human serum albumin (i.e., amino acids 1-585 of human serum albumin as shown in FIGS. 1 and 2 of EP Patent 0 322 094) which is herein incorporated by reference in its entirety. In another preferred embodiment, polypeptides and/or antibodies of the present invention (including fragments or variants thereof) are fused with polypeptide fragments comprising, or alternatively consisting of, amino acid residues 1-x of human serum albumin, where x is an integer from 1 to 585 and the albumin fragment has human serum albumin activity. In another preferred embodiment, polypeptides and/or antibodies of the present invention (including fragments or variants thereof) are fused with polypeptide fragments comprising, or alternatively consisting of, amino acid residues 1-z of human serum albumin, where z is an integer from 369 to 419, as described in U.S. Pat. No. 5,766,883 herein incorporated by reference in its entirety. Polypeptides and/or antibodies of the present invention (including fragments or variants thereof) may be fused to either the N- or C-terminal end of the heterologous protein (e.g., immunoglobulin Fc polypeptide or human serum albumin polypeptide). Polynucleotides encoding fusion proteins of the invention are also encompassed by the invention.

Such fusion proteins as those described above may facilitate purification and may increase half-life in vivo. This has been shown for chimeric proteins consisting of the first two domains of the human CD4-polypeptide and various domains of the constant regions of the heavy or light chains of mammalian immunoglobulins. See, e.g., EP 394,827; Traunecker et al., Nature, 331:84-86 (1988). Enhanced delivery of an antigen across the epithelial barrier to the immune system has been demonstrated for antigens (e.g., insulin) conjugated to an FcRn binding partner such as IgG or Fc fragments (see, e.g., PCT Publications WO 96/22024 and WO 99/04813). IgG Fusion proteins that have a disulfide-linked dimeric structure due to the IgG portion desulfide bonds have also been found to be more efficient in binding and neutralizing other molecules than monomeric polypeptides or fragments thereof alone. See, e.g., Fountoulakis et al., J. Biochem., 270:3958-3964 (1995). Nucleic acids encoding the above epitopes can also be recombined with a gene of interest as an epitope tag (e.g., the hemagglutinin ("HA") tag or flag tag) to aid in detection and purification of the expressed polypeptide. For example, a system described by Janknecht et al. allows for the ready purification of non-denatured fusion proteins expressed in human cell lines (Janknecht et al., 1991, Proc. Natl. Acad. Sci. USA 88:8972-897). In this system, the gene of interest is subcloned into a vaccinia recombination plasmid such that the open reading frame of the gene is translationally fused to an amino-terminal tag consisting of six histidine residues. The tag serves as a matrix binding domain for the fusion protein. Extracts from cells infected with the recombinant vaccinia virus are loaded onto Ni2+ nitriloacetic acid-agarose column and histidine-tagged proteins can be selectively eluted with imidazole-containing buffers.

Additional fusion proteins of the invention may be generated through the techniques of gene-shuffling, motif-shuffling, exon-shuffling, and/or codon-shuffling (collectively referred to as "DNA shuffling"). DNA shuffling may be employed to modulate the activities of polypeptides of the invention, such methods can be used to generate polypeptides with altered activity, as well as agonists and antagonists of the polypeptides. See, generally, U.S. Pat. Nos. 5,605,793; 5,811,238; 5,830,721; 5,834,252; and 5,837,458, and Patten et al., Curr. Opinion Biotechnol. 8:724-33 (1997); Harayama, Trends Biotechnol. 16(2):76-82 (1998); Hansson, et al., J. Mol. Biol. 287:265-76 (1999); and Lorenzo and Blasco, Biotechniques 24(2):308-13 (1998) (each of these patents and publications are hereby incorporated by reference in its entirety). In one embodiment, alteration of polynucleotides corresponding to SEQ ID NO:X and the polypeptides encoded by these polynucleotides may be achieved by DNA shuffling. DNA shuffling involves the assembly of two or more DNA segments by homologous or site-specific recombination to generate variation in the polynucleotide sequence. In another embodiment, polynucleotides of the invention, or the encoded polypeptides, may be altered by being subjected to random mutagenesis by error-prone PCR, random nucleotide insertion or other methods prior to recombination. In another embodiment, one or more components, motifs, sections, parts, domains, fragments, etc., of a polynucleotide encoding a polypeptide of the invention may be recombined with one or more components, motifs, sections, parts, domains, fragments, etc. of one or more heterologous molecules.

Antibodies

Further polypeptides of the invention relate to antibodies and T-cell antigen receptors (TCR) which immunospecifically bind a polypeptide, polypeptide fragment, or variant of SEQ ID NO:Y, and/or an epitope, of the present invention (as determined by immunoassays well known in the art for assaying specific antibody-antigen binding). Antibodies of the invention include, but are not limited to, polyclonal, monoclonal, multispecific, human, humanized or chimeric antibodies, single chain antibodies, Fab fragments, F(ab') fragments, fragments produced by a Fab expression library, anti-idiotypic (anti-Id) antibodies (including, e.g., anti-Id antibodies to antibodies of the invention), and epitope-binding fragments of any of the above. The term "antibody," as used herein, refers to immunoglobulin molecules and immunologically active portions of immunoglobulin molecules, i.e., molecules that contain an antigen binding site that immunospecifically binds an antigen. The immunoglobulin molecules of the invention can be of any type (e.g., IgG, IgE, IgM, IgD, IgA and IgY), class (e.g., IgG1, IgG2, IgG3, IgG4, IgA1 and IgA2) or subclass of immunoglobulin molecule. In preferred embodiments, the immunoglobulin molecules of the invention are IgG1. In other preferred embodiments, the immunoglobulin molecules of the invention are IgG4.

Most preferably the antibodies are human antigen-binding antibody fragments of the present invention and include, but are not limited to, Fab, Fab' and F(ab')2, Fd, single-chain Fvs (scFv), single-chain antibodies, disulfide-linked Fvs (sdFv) and fragments comprising either a VL or VH domain. Antigen-binding antibody fragments, including single-chain antibodies, may comprise the variable region(s) alone or in combination with the entirety or a portion of the following: hinge region, CH1, CH2, and CH3 domains. Also included in the invention are antigen-binding fragments also comprising any combination of variable region(s) with a hinge region, CHL CH2, and CH3 domains. The antibodies of the invention may be from any animal origin including birds and mammals. Preferably, the antibodies are human, murine (e.g., mouse and rat), donkey, ship rabbit, goat, guinea pig, camel, horse, or chicken. As used herein, "human" antibodies include antibodies having the amino acid sequence of a human immunoglobulin and include antibodies isolated from human immunoglobulin libraries or from animals transgenic for one or more human immunoglobulin and that do not express endogenous immunoglobulins, as described infra and, for example in, U.S. Pat. No. 5,939,598 by Kucherlapati et al. The antibodies of the present invention may be monospecific, bispecific, trispecific or of greater multispecificity. Multispecific antibodies may be specific for different epitopes of a polypeptide of the present invention or may be specific for both a polypeptide of the present invention as well as for a heterologous epitope, such as a heterologous polypeptide or solid support material. See, e.g., PCT publications WO 93/17715; WO 92/08802; WO 91/00360; WO 92/05793; Tuft, et al., J. Immunol. 147:60-69 (1991); U.S. Pat. Nos. 4,474,893; 4,714, 681; 4,925,648; 5,573,920; 5,601,819; Kostelny et al., J. Immunol. 148:1547-1553 (1992).

Antibodies of the present invention may be described or specified in terms of the epitope(s) or portion(s) of a polypeptide of the present invention which they recognize or specifically bind. The epitope(s) or polypeptide portion(s) may be specified as described herein, e.g., by N-terminal and C-terminal positions, by size in contiguous amino acid residues, or listed in the Tables and Figures. Antibodies which specifically bind any epitope or polypeptide of the present invention may also be excluded. Therefore, the present invention includes antibodies that specifically bind polypeptides of the present invention, and allows for the exclusion of the same.

Antibodies of the present invention may also be described or specified in terms of their cross-reactivity. Antibodies that do not bind any other analog, ortholog, or homolog of a polypeptide of the present invention are included. Antibodies that bind polypeptides with at least 95%, at least 90%, at least 85%, at least 80%, at least 75%, at least 70%, at least 65%, at least 60%, at least 55%, and at least 50% identity (as calculated using methods known in the art and described herein) to a polypeptide of the present invention are also included in the present invention. In specific embodiments, antibodies of the present invention cross-react with murine, rat and/or rabbit homologs of human proteins and the corresponding epitopes thereof. Antibodies that do not bind polypeptides with less than 95%, less than 90%, less than 85%, less than 80%, less than 75%, less than 70%, less than 65%, less than 60%, less than 55%, and less than 50% identity (as calculated using methods known in the art and described herein) to a polypeptide of the present invention are also included in the present invention. In a specific embodiment, the above-described cross-reactivity is with respect to any single specific antigenic or immunogenic polypeptide, or combination(s) of 2, 3, 4, 5, or more of the specific antigenic and/or immunogenic polypeptides disclosed herein. Further included in the present invention are antibodies which bind polypeptides encoded by polynucleotides which hybridize to a polynucleotide of the present invention under stringent hybridization conditions (as described herein). Antibodies of the present invention may also be described or specified in terms of their binding affinity to a polypeptide of the invention. Preferred binding affinities include those with a dissociation constant or Kd less than $5 \times 10^{-2}$ M, $10^{-2}$ M, $5 \times 10^{-3}$ M, $10^{-3}$ M, $5 \times 10^{-4}$ M, $10^{-4}$ M, $5 \times 10^{-5}$ M, $10^{-5}$ M, $5 \times 10^{-6}$ M, $10^{-6}$M, $5 \times 10^{-7}$ M, $10^{-7}$ M, $5 \times 10^{-8}$ M, $10^{-8}$M $5 \times 10^{-9}$ M, $10^{-9}$M, $5 \times 10^{-10}$ M, $10^{-10}$M $5 \times 10^{-11}$ M, $10^{-11}$ M, $5 \times 10^{-12}$ M, $10^{-12}$M, $5 \times 10^{-13}$ M, $10^{-13}$ M, $5 \times 10^{-14}$ M, $10^{-14}$ M, $5 \times 10^{-15}$ M, or $10^{-15}$ M.

The invention also provides antibodies that competitively inhibit binding of an antibody to an epitope of the invention as determined by any method known in the art for determining competitive binding, for example, the immunoassays described herein. In preferred embodiments, the antibody competitively inhibits binding to the epitope by at least 95%, at least 90%, at least 85%, at least 80%, at least 75%, at least 70%, at least 60%, or at least 50%.

Antibodies of the present invention may act as agonists or antagonists of the polypeptides of the present invention. For example, the present invention includes antibodies which disrupt the receptor/ligand interactions with the polypeptides of the invention either partially or fully. Preferrably, antibodies of the present invention bind an antigenic epitope disclosed herein, or a portion thereof. The invention features both receptor-specific antibodies and ligand-specific antibodies. The invention also features receptor-specific antibodies which do not prevent ligand binding but prevent receptor activation. Receptor activation (i.e., signaling) may be determined by techniques described herein or otherwise known in the art. For example, receptor activation can be determined by detecting the phosphorylation (e.g., tyrosine or serine/threonine) of the receptor or its substrate by immunoprecipitation followed by western blot analysis (for example, as described supra). In specific embodiments, antibodies are provided that inhibit ligand activity or receptor activity by at least 95%, at least 90%, at least 85%, at least 80%, at least 75%, at least 70%, at least 60%, or at least 50% of the activity in absence of the antibody.

The invention also features receptor-specific antibodies which both prevent ligand binding and receptor activation as well as antibodies that recognize the receptor-ligand complex, and, preferably, do not specifically recognize the unbound receptor or the unbound ligand. Likewise, included in the invention are neutralizing antibodies which bind the ligand and prevent binding of the ligand to the receptor, as well as antibodies which bind the ligand, thereby preventing receptor activation, but do not prevent the ligand from binding the receptor. Further included in the invention are antibodies which activate the receptor. These antibodies may act as receptor agonists, i.e., potentiate or activate either all or a subset of the biological activities of the ligand-mediated receptor activation, for example, by inducing dimerization of the receptor. The antibodies may be specified as agonists, antagonists or inverse agonists for biological activities comprising the specific biological activities of the peptides of the invention disclosed herein. The above antibody agonists can be made using methods known in the art. See, e.g., PCT publication WO 96/40281; U.S. Pat. No. 5,811,097; Deng et al., Blood 92(6):1981-1988 (1998); Chen et al., Cancer Res. 58(16):3668-3678 (1998); Harrop et al., J. Immunol. 161(4): 1786-1794 (1998); Zhu et al., Cancer Res. 58(15):3209-3214 (1998); Yoon et al., J. Immunol. 160(7):3170-3179 (1998); Prat et al., J. Cell. Sci. 111(Pt2):237-247 (1998); Pitard et al., J. Immunol. Methods 205(2): 177-190 (1997); Liautard et al., Cytokine 9(4):233-241 (1997); Carlson et al., J. Biol. Chem. 272(17):11295-11301 (1997); Taryman et al., Neuron 14(4): 755-762 (1995); Muller et al., Structure 6(9):1153-1167 (1998); Bartunek et al., Cytokine 8(1):14-20 (1996) (which are all incorporated by reference herein in their entireties).

Antibodies of the present invention may be used, for example, but not limited to, to purify, detect, and target the polypeptides of the present invention, including both in vitro and in vivo diagnostic and therapeutic methods. For example, the antibodies have use in immunoassays for qualitatively and quantitatively measuring levels of the polypeptides of the present invention in biological samples. See, e.g., Harlow et al., Antibodies: A Laboratory Manual, (Cold Spring Harbor Laboratory Press, 2nd ed. 1988) (incorporated by reference herein in its entirety).

As discussed in more detail below, the antibodies of the present invention may be used either alone or in combination with other compositions. The antibodies may further be recombinantly fused to a heterologous polypeptide at the N- or C-terminus or chemically conjugated (including covalently and non-covalently conjugations) to polypeptides or other compositions. For example, antibodies of the present invention may be recombinantly fused or conjugated to molecules useful as labels in detection assays and effector molecules such as heterologous polypeptides, drugs, radionuclides, or toxins. See, e.g., PCT publications WO 92/08495; WO 91/14438; WO 89/12624; U.S. Pat. No. 5,314,995; and EP 396,387.

The antibodies of the invention include derivatives that are modified, i.e, by the covalent attachment of any type of molecule to the antibody such that covalent attachment does not prevent the antibody from generating an anti-idiotypic response. For example, but not by way of limitation, the antibody derivatives include antibodies that have been modified, e.g., by glycosylation, acetylation, pegylation, phosphylation, amidation, derivatization by known protecting/blocking groups, proteolytic cleavage, linkage to a cellular ligand or other protein, etc. Any of numerous chemical modifications may be carried out by known techniques, including, but not limited to specific chemical cleavage, acetylation, formylation, metabolic synthesis of tunicamycin, etc. Additionally, the derivative may contain one or more non-classical amino acids.

The antibodies of the present invention may be generated by any suitable method known in the art. Polyclonal antibodies to an antigen-of-interest can be produced by various procedures well known in the art. For example, a polypeptide of the invention can be administered to various host animals including, but not limited to, rabbits, mice, rats, etc. to induce the production of sera containing polyclonal antibodies specific for the antigen. Various adjuvants may be used to increase the immunological response, depending on the host species, and include but are not limited to, Freund's (complete and incomplete), mineral gels such as aluminum hydroxide, surface active substances such as lysolecithin, pluronic polyols, polyanions, peptides, oil emulsions, keyhole limpet hemocyanins, dinitrophenol, and potentially useful human adjuvants such as BCG (bacille Calmette-Guerin) and *corynebacterium parvum*. Such adjuvants are also well known in the art.

Monoclonal antibodies can be prepared using a wide variety of techniques known in the art including the use of hybridoma, recombinant, and phage display technologies, or a combination thereof. For example, monoclonal antibodies can be produced using hybridoma techniques including those known in the art and taught, for example, in Harlow et al., Antibodies: A Laboratory Manual, (Cold Spring Harbor Laboratory Press, 2nd ed. 1988); Hammerling, et al., in: Monoclonal Antibodies and T-Cell Hybridomas 563-681 (Elsevier, N.Y., 1981) (said references incorporated by reference in their entireties). The term "monoclonal antibody" as used herein is not limited to antibodies produced through hybridoma technology. The term "monoclonal antibody" refers to an antibody that is derived from a single clone, including any eukaryotic, prokaryotic, or phage clone, and not the method by which it is produced.

Methods for producing and screening for specific antibodies using hybridoma technology are routine and well known in the art and are discussed in detail in the Examples (e.g., Example 16). In a non-limiting example, mice can be immunized with a polypeptide of the invention or a cell expressing such peptide. Once an immune response is detected, e.g., antibodies specific for the antigen are detected in the mouse serum, the mouse spleen is harvested and splenocytes isolated. The splenocytes are then fused by well known techniques to any suitable myeloma cells, for example cells from cell line SP20 available from the ATCC. Hybridomas are selected and cloned by limited dilution. The hybridoma clones are then assayed by methods known in the art for cells that secrete antibodies capable of binding a polypeptide of the invention. Ascites fluid, which generally contains high levels of antibodies, can be generated by immunizing mice with positive hybridoma clones.

Accordingly, the present invention provides methods of generating monoclonal antibodies as well as antibodies produced by the method comprising culturing a hybridoma cell secreting an antibody of the invention wherein, preferably, the hybridoma is generated by fusing splenocytes isolated from a mouse immunized with an antigen of the invention with myeloma cells and then screening the hybridomas resulting from the fusion for hybridoma clones that secrete an antibody able to bind a polypeptide of the invention.

Antibody fragments which recognize specific epitopes may be generated by known techniques. For example, Fab and F(ab')2 fragments of the invention may be produced by proteolytic cleavage of immunoglobulin molecules, using enzymes such as papain (to produce Fab fragments) or pepsin (to produce F(ab')2 fragments). F(ab')2 fragments contain the variable region, the light chain constant region and the CH1 domain of the heavy chain.

For example, the antibodies of the present invention can also be generated using various phage display methods known in the art. In phage display methods, functional antibody domains are displayed on the surface of phage particles which carry the polynucleotide sequences encoding them. In a particular embodiment, such phage can be utilized to display antigen binding domains expressed from a repertoire or combinatorial antibody library (e.g., human or murine). Phage expressing an antigen binding domain that binds the antigen of interest can be selected or identified with antigen, e.g., using labeled antigen or antigen bound or captured to a solid surface or bead. Phage used in these methods are typically filamentous phage including fd and M13 binding domains expressed from phage with Fab, Fv or disulfide stabilized Fv antibody domains recombinantly fused to either the phage gene III or gene VIII protein. Examples of phage display methods that can be used to make the antibodies of the present invention include those disclosed in Brinkman et al., J. Immunol. Methods 182:41-50 (1995); Ames et al., J. Immunol. Methods 184:177-186 (1995); Kettleborough et al., Eur. J. Immunol. 24:952-958 (1994); Persic et al., Gene 187 9-18 (1997); Burton et al., Advances in Immunology 57:191-280 (1994); PCT application No. PCT/GB91/01134; PCT publications WO 90/02809; WO 91/10737; WO 92/01047; WO 92/18619; WO 93/11236; WO 95/15982; WO 95/20401; and U.S. Pat. Nos. 5,698,426; 5,223,409; 5,403,484; 5,580,717; 5,427,908; 5,750,753; 5,821,047; 5,571,698; 5,427,908; 5,516,637; 5,780,225; 5,658,727; 5,733,743 and 5,969,108; each of which is incorporated herein by reference in its entirety.

As described in the above references, after phage selection, the antibody coding regions from the phage can be isolated and used to generate whole antibodies, including human antibodies, or any other desired antigen binding fragment, and expressed in any desired host, including mammalian cells, insect cells, plant cells, yeast, and bacteria, e.g., as described in detail below. For example, techniques to recombinantly produce Fab, Fab' and F(ab')2 fragments can also be employed using methods known in the art such as those disclosed in PCT publication WO 92/22324; Mullinax et al., BioTechniques 12(6):864-869 (1992); and Sawai et al., AJRI 34:26-34 (1995); and Better et al., Science 240:1041-1043 (1988) (said references incorporated by reference in their entireties).

Examples of techniques which can be used to produce single-chain Fvs and antibodies include those described in U.S. Pat. Nos. 4,946,778 and 5,258,498; Huston et al., Methods in Enzymology 203:46-88 (1991); Shu et al., PNAS 90:7995-7999 (1993); and Skerra et al., Science 240:1038-1040 (1988). For some uses, including in vivo use of antibodies in humans and in vitro detection assays, it may be preferable to use chimeric, humanized, or human antibodies. A chimeric antibody is a molecule in which different portions of the antibody are derived from different animal species, such as antibodies having a variable region derived from a murine monoclonal antibody and a human immunoglobulin constant region. Methods for producing chimeric antibodies are known in the art. See e.g., Morrison, Science 229:1202 (1985); Oi et al., BioTechniques 4:214 (1986); Gillies et al., (1989) J. Immunol. Methods 125:191-202; U.S. Pat. Nos. 5,807,715; 4,816,567; and 4,816,397, which are incorporated herein by reference in their entirety. Humanized antibodies are antibody molecules from non-human species antibody that binds the desired antigen having one or more complementarity determining regions (CDRs) from the non-human species and a framework regions from a human immunoglobulin molecule. Often, framework residues in the human framework regions will be substituted with the corresponding residue from the CDR donor antibody to alter, preferably improve, antigen binding. These framework substitutions are identified by methods well known in the art, e.g., by modeling of the interactions of the CDR and framework residues to identify framework residues important for antigen binding and sequence comparison to identify unusual framework residues at particular positions. (See, e.g., Queen et al., U.S. Pat. No. 5,585,089; Riechmann et al., Nature 332:323 (1988), which are incorporated herein by reference in their entireties.) Antibodies can be humanized using a variety of techniques known in the art including, for example, CDR-grafting (EP 239,400; PCT publication WO 91/09967; U.S. Pat. Nos. 5,225,539; 5,530,101; and 5,585,089), veneering or resurfacing (EP 592,106; EP 519,596; Padlan, Molecular Immunology 28(4/5):489-498 (1991); Studnicka et al., Protein Engineering 7(6):805-814 (1994); Roguska. et al., PNAS 91:969-973 (1994)), and chain shuffling (U.S. Pat. No. 5,565,332).

Completely human antibodies are particularly desirable for therapeutic treatment of human patients. Human antibodies can be made by a variety of methods known in the art including phage display methods described above using antibody libraries derived from human immunoglobulin sequences. See also, U.S. Pat. Nos. 4,444,887 and 4,716,111; and PCT publications WO 98/46645, WO 98/50433, WO 98/24893, WO 98/16654, WO 96/34096, WO 96/33735, and WO 91/10741; each of which is incorporated herein by reference in its entirety.

Human antibodies can also be produced using transgenic mice which are incapable of expressing functional endogenous immunoglobulins, but which can express human immunoglobulin genes. For example, the human heavy and light chain immunoglobulin gene complexes may be introduced randomly or by homologous recombination into mouse embryonic stem cells. Alternatively, the human variable region, constant region, and diversity region may be introduced into mouse embryonic stem cells in addition to the human heavy and light chain genes. The mouse heavy and light chain immunoglobulin genes may be rendered non-functional separately or simultaneously with the introduction of human immunoglobulin loci by homologous recombination. In particular, homozygous deletion of the JH region prevents endogenous antibody production. The modified embryonic stem cells are expanded and microinjected into blastocysts to produce chimeric mice. The chimeric mice are then bred to produce homozygous offspring which express human antibodies. The transgenic mice are immunized in the normal fashion with a selected antigen, e.g., all or a portion of a polypeptide of the invention. Monoclonal antibodies directed against the antigen can be obtained from the immunized, transgenic mice using conventional hybridoma technology. The human immunoglobulin transgenes harbored by the transgenic mice rearrange during B cell differentiation, and subsequently undergo class switching and somatic mutation. Thus, using such a technique, it is possible to produce therapeutically useful IgG, IgA, IgM and IgE antibodies. For an overview of this technology for producing human antibodies, see Lonberg and Huszar, Int. Rev. Immunol 13:65-93 (1995). For a detailed discussion of this technology for producing human antibodies and human monoclonal antibodies and protocols for producing such antibodies, see, e.g., PCT publications WO 98/24893; WO 92/01047; WO 96/34096; WO 96/33735; European Patent No. 0 598 877; U.S. Pat. Nos. 5,413,923; 5,625,126; 5,633,425; 5,569,825; 5,661,016; 5,545,806; 5,814,318; 5,885,793; 5,916,771; and 5,939,598, which are incorporated by reference herein in their entirety. In addition, companies such as Abgenix, Inc. (Freemont, Calif.) and Genpharm (San Jose, Calif.) can be engaged to provide human antibodies directed against a selected antigen using technology similar to that described above.

Completely human antibodies which recognize a selected epitope can be generated using a technique referred to as "guided selection." In this approach a selected non-human monoclonal antibody, e.g., a mouse antibody, is used to guide the selection of a completely human antibody recognizing the same epitope. (Jespers et al., Bio/technology 12:899-903 (1988)).

Further, antibodies to the polypeptides of the invention can, in turn, be utilized to generate anti-idiotype antibodies that "mimic" polypeptides of the invention using techniques well known to those skilled in the art. (See, e.g., Greenspan & Bona, FASEB J. 7(5):437-444; (1989) and Nissinoff, J. Immunol. 147(8):2429-2438 (1991)). For example, antibodies which bind to and competitively inhibit polypeptide multimerization and/or binding of a polypeptide of the invention to a ligand can be used to generate anti-idiotypes that "mimic" the polypeptide multimerization and/or binding domain and, as a consequence, bind to and neutralize polypeptide and/or its ligand. Such neutralizing anti-idiotypes or Fab fragments of such anti-idiotypes can be used in therapeutic regimens to neutralize polypeptide ligand. For example, such anti-idiotypic antibodies can be used to bind a polypeptide of the invention and/or to bind its ligands/receptors, and thereby block its biological activity.

Polynucleotides Encoding Antibodies

The invention further provides polynucleotides comprising a nucleotide sequence encoding an antibody of the invention and fragments thereof. The invention also encompasses polynucleotides that hybridize under stringent or lower stringency hybridization conditions, e.g., as defined supra, to polynucleotides that encode an antibody, preferably, that specifically binds to a polypeptide of the invention, preferably, an antibody that binds to a polypeptide having the amino acid sequence of SEQ ID NO:Y.

The polynucleotides may be obtained, and the nucleotide sequence of the polynucleotides determined, by any method known in the art. For example, if the nucleotide sequence of the antibody is known, a polynucleotide encoding the antibody may be assembled from chemically synthesized oligonucleotides (e.g., as described in Kutmeier et al., BioTechniques 17:242 (1994)), which, briefly, involves the synthesis of overlapping oligonucleotides containing portions of the sequence encoding the antibody, annealing and ligating of those oligonucleotides, and then amplification of the ligated oligonucleotides by PCR.

Alternatively, a polynucleotide encoding an antibody may be generated from nucleic acid from a suitable source. If a clone containing a nucleic acid encoding a particular antibody is not available, but the sequence of the antibody molecule is known, a nucleic acid encoding the immunoglobulin may be chemically synthesized or obtained from a suitable source (e.g., an antibody cDNA library, or a cDNA library generated from, or nucleic acid, preferably poly A+ RNA, isolated from, any tissue or cells expressing the antibody, such as hybridoma cells selected to express an antibody of the invention) by PCR amplification using synthetic primers hybridizable to the 3' and 5' ends of the sequence or by cloning using an oligonucleotide probe specific for the particular gene sequence to identify, e.g., a cDNA clone from a cDNA library that encodes the antibody. Amplified nucleic acids generated by PCR may then be cloned into replicable cloning vectors using any method well known in the art.

Once the nucleotide sequence and corresponding amino acid sequence of the antibody is determined, the nucleotide sequence of the antibody may be manipulated using methods well known in the art for the manipulation of nucleotide sequences, e.g., recombinant DNA techniques, site directed mutagenesis, PCR, etc. (see, for example, the techniques described in Sambrook et al., 1990, Molecular Cloning, A Laboratory Manual, 2d Ed., Cold Spring Harbor Laboratory, Cold Spring Harbor, N.Y. and Ausubel et al., eds., 1998, Current Protocols in Molecular Biology, John Wiley & Sons, NY, which are both incorporated by reference herein in their entireties), to generate antibodies having a different amino acid sequence, for example to create amino acid substitutions, deletions, and/or insertions.

In a specific embodiment, the amino acid sequence of the heavy and/or light chain variable domains may be inspected to identify the sequences of the complementarity determining regions (CDRs) by methods that are well know in the art, e.g., by comparison to known amino acid sequences of other heavy and light chain variable regions to determine the regions of sequence hypervariability. Using routine recombinant DNA techniques, one or more of the CDRs may be inserted within framework regions, e.g., into human framework regions to humanize a non-human antibody, as described supra. The framework regions may be naturally occurring or consensus framework regions, and preferably human framework regions (see, e.g., Chothia et al., J. Mol. Biol. 278: 457-479 (1998) for a listing of human framework regions). Preferably, the polynucleotide generated by the combination of the framework regions and CDRs encodes an antibody that specifically binds a polypeptide of the invention. Preferably, as discussed supra, one or more amino acid substitutions may be made within the framework regions, and, preferably, the amino acid substitutions improve binding of the antibody to its antigen. Additionally, such methods may be used to make amino acid substitutions or deletions of one or more variable region cysteine residues participating in an intrachain disulfide bond to generate antibody molecules lacking one or more intrachain disulfide bonds. Other alterations to the polynucleotide are encompassed by the present invention and within the skill of the art.

In addition, techniques developed for the production of "chimeric antibodies" (Morrison et al., Proc. Natl. Acad. Sci. 81:851-855 (1984); Neuberger et al., Nature 312:604-608 (1984); Takeda et al., Nature 314:452-454 (1985)) by splicing genes from a mouse antibody molecule of appropriate antigen specificity together with genes from a human antibody molecule of appropriate biological activity can be used. As described supra, a chimeric antibody is a molecule in which different portions are derived from different animal species, such as those having a variable region derived from a murine mAb and a human immunoglobulin constant region, e.g., humanized antibodies.

Alternatively, techniques described for the production of single chain antibodies (U.S. Pat. No. 4,946,778; Bird, Science 242:423-42 (1988); Huston et al., Proc. Natl. Acad. Sci. USA 85:5879-5883 (1988); and Ward et al., Nature 334:544-54 (1989)) can be adapted to produce single chain antibodies. Single chain antibodies are formed by linking the heavy and light chain fragments of the Fv region via an amino acid bridge, resulting in a single chain polypeptide. Techniques for the assembly of functional Fv fragments in E. coli may also be used (Skerra et al., Science 242:1038-1041 (1988)).

Methods of Producing Antibodies

The antibodies of the invention can be produced by any method known in the art for the synthesis of antibodies, in particular, by chemical synthesis or preferably, by recombinant expression techniques.

Recombinant expression of an antibody of the invention, or fragment, derivative or analog thereof, (e.g., a heavy or light chain of an antibody of the invention or a single chain antibody of the invention), requires construction of an expression vector containing a polynucleotide that encodes the antibody. Once a polynucleotide encoding an antibody molecule or a heavy or light chain of an antibody, or portion thereof (preferably containing the heavy or light chain variable domain), of the invention has been obtained, the vector for the production of the antibody molecule may be produced by recombinant DNA technology using techniques well known in the art. Thus, methods for preparing a protein by expressing a polynucleotide containing an antibody encoding nucleotide sequence are described herein. Methods which are well known to those skilled in the art can be used to construct expression vectors containing antibody coding sequences and appropriate transcriptional and translational control signals. These methods include, for example, in vitro recombinant DNA techniques, synthetic techniques, and in vivo genetic recombination. The invention, thus, provides replicable vectors comprising a nucleotide sequence encoding an antibody molecule of the invention, or a heavy or light chain thereof, or a heavy or light chain variable domain, operably linked to a promoter. Such vectors may include the nucleotide sequence encoding the constant region of the antibody molecule (see, e.g., PCT Publication WO 86/05807; PCT Publication WO 89/01036; and U.S. Pat. No. 5,122,464) and the variable domain of the antibody may be cloned into such a vector for expression of the entire heavy or light chain.

The expression vector is transferred to a host cell by conventional techniques and the transfected cells are then cultured by conventional techniques to produce an antibody of the invention. Thus, the invention includes host cells containing a polynucleotide encoding an antibody of the invention, or a heavy or light chain thereof, or a single chain antibody of the invention, operably linked to a heterologous promoter. In preferred embodiments for the expression of double-chained antibodies, vectors encoding both the heavy and light chains may be co-expressed in the host cell for expression of the entire immunoglobulin molecule, as detailed below.

A variety of host-expression vector systems may be utilized to express the antibody molecules of the invention. Such host-expression systems represent vehicles by which the coding sequences of interest may be produced and subsequently purified, but also represent cells which may, when transformed or transfected with the appropriate nucleotide coding sequences, express an antibody molecule of the invention in situ. These include but are not limited to microorganisms such as bacteria (e.g., *E. coli, B. subtilis*) transformed with recombinant bacteriophage DNA, plasmid DNA or cosmid DNA expression vectors containing antibody coding sequences; yeast (e.g., *Saccharomyces, Pichia*) transformed with recombinant yeast expression vectors containing antibody coding sequences; insect cell systems infected with recombinant virus expression vectors (e.g., baculovirus) containing antibody coding sequences; plant cell systems infected with recombinant virus expression vectors (e.g., cauliflower mosaic virus, CaMV; tobacco mosaic virus, TMV) or transformed with recombinant plasmid expression vectors (e.g., Ti plasmid) containing antibody coding sequences; or mammalian cell systems (e.g., COS, CHO, BHK, 293, 3T3 cells) harboring recombinant expression constructs containing promoters derived from the genome of mammalian cells (e.g., metallothionein promoter) or from mammalian viruses (e.g., the adenovirus late promoter; the vaccinia virus 7.5K promoter). Preferably, bacterial cells such as *Escherichia coli*, and more preferably, eukaryotic cells, especially for the expression of whole recombinant antibody molecule, are used for the expression of a recombinant antibody molecule. For example, mammalian cells such as Chinese hamster ovary cells (CHO), in conjunction with a vector such as the major intermediate early gene promoter element from human cytomegalovirus is an effective expression system for antibodies (Foecking et al., Gene 45:101 (1986); Cockett et al., Bio/Technology 8:2 (1990)).

In bacterial systems, a number of expression vectors may be advantageously selected depending upon the use intended for the antibody molecule being expressed. For example, when a large quantity of such a protein is to be produced, for the generation of pharmaceutical compositions of an antibody molecule, vectors which direct the expression of high levels of fusion protein products that are readily purified may be desirable. Such vectors include, but are not limited to, the *E. coli* expression vector pUR278 (Ruther et al., EMBO J. 2:1791 (1983)), in which the antibody coding sequence may be ligated individually into the vector in frame with the lac Z coding region so that a fusion protein is produced; pIN vectors (Inouye & Inouye, Nucleic Acids Res. 13:3101-3109 (1985); Van Heeke & Schuster, J. Biol. Chem. 24:5503-5509 (1989)); and the like. pGEX vectors may also be used to express foreign polypeptides as fusion proteins with glutathione 5-transferase (GST). In general, such fusion proteins are soluble and can easily be purified from lysed cells by adsorption and binding to matrix glutathione-agarose beads followed by elution in the presence of free glutathione. The pGEX vectors are designed to include thrombin or factor Xa protease cleavage sites so that the cloned target gene product can be released from the GST moiety.

In an insect system, *Autographa californica* nuclear polyhedrosis virus (AcNPV) is used as a vector to express foreign genes. The virus grows in *Spodoptera frugiperda* cells. The antibody coding sequence may be cloned individually into non-essential regions (for example the polyhedrin gene) of the virus and placed under control of an AcNPV promoter (for example the polyhedrin promoter).

In mammalian host cells, a number of viral-based expression systems may be utilized. In cases where an adenovirus is used as an expression vector, the antibody coding sequence of interest may be ligated to an adenovirus transcription/translation control complex, e.g., the late promoter and tripartite leader sequence. This chimeric gene may then be inserted in the adenovirus genome by in vitro or in vivo recombination. Insertion in a non-essential region of the viral genome (e.g., region E1 or E3) will result in a recombinant virus that is viable and capable of expressing the antibody molecule in infected hosts. (e.g., see Logan & Shenk, Proc. Natl. Acad. Sci. USA 81:355-359 (1984)). Specific initiation signals may also be required for efficient translation of inserted antibody coding sequences. These signals include the ATG initiation codon and adjacent sequences. Furthermore, the initiation codon must be in phase with the reading frame of the desired coding sequence to ensure translation of the entire insert. These exogenous translational control signals and initiation codons can be of a variety of origins, both natural and synthetic. The efficiency of expression may be enhanced by the inclusion of appropriate transcription enhancer elements, transcription terminators, etc. (see Bittner et al., Methods in Enzymol. 153:51-544 (1987)).

In addition, a host cell strain may be chosen which modulates the expression of the inserted sequences, or modifies and processes the gene product in the specific fashion desired. Such modifications (e.g., glycosylation) and processing (e.g., cleavage) of protein products may be important for the function of the protein. Different host cells have characteristic and specific mechanisms for the post-translational processing and modification of proteins and gene products. Appropriate cell lines or host systems can be chosen to ensure the correct modification and processing of the foreign protein expressed. To this end, eukaryotic host cells which possess the cellular machinery for proper processing of the primary transcript, glycosylation, and phosphorylation of the gene product may be used. Such mammalian host cells include but are not limited to CHO, VERY, BHK, Hela, COS, MDCK, 293, 3T3, WI38, and in particular, breast cancer cell lines such as, for example, BT483, Hs578T, HTB2, BT20 and T47D, and normal mammary gland cell line such as, for example, CRL7030 and Hs578Bst.

For long-term, high-yield production of recombinant proteins, stable expression is preferred. For example, cell lines which stably express the antibody molecule may be engineered. Rather than using expression vectors which contain viral origins of replication, host cells can be transformed with DNA controlled by appropriate expression control elements (e.g., promoter, enhancer, sequences, transcription terminators, polyadenylation sites, etc.), and a selectable marker. Following the introduction of the foreign DNA, engineered cells may be allowed to grow for 1-2 days in an enriched media, and then are switched to a selective media. The selectable marker in the recombinant plasmid confers resistance to the selection and allows cells to stably integrate the plasmid into their chromosomes and grow to form foci which in turn can be cloned and expanded into cell lines. This method may advantageously be used to engineer cell lines which express the antibody molecule. Such engineered cell lines may be particularly useful in screening and evaluation of compounds that interact directly or indirectly with the antibody molecule.

A number of selection systems may be used, including but not limited to the herpes simplex virus thymidine kinase (Wigler et al., Cell 11:223 (1977)), hypoxanthine-guanine phosphoribosyltransferase (Szybalska & Szybalski, Proc. Natl. Acad. Sci. USA 48:202 (1992)), and adenine phosphoribosyltransferase (Lowy et al., Cell 22:817 (1980)) genes can be employed in tk–, hgprt– or aprt– cells, respectively. Also, antimetabolite resistance can be used as the basis of selection for the following genes: dhfr, which confers resistance to methotrexate (Wigler et al., Natl. Acad. Sci. USA 77:357 (1980); O'Hare et al., Proc. Natl. Acad. Sci. USA 78:1527 (1981)); gpt, which confers resistance to mycophenolic acid (Mulligan & Berg, Proc. Natl. Acad. Sci. USA 78:2072 (1981)); neo, which confers resistance to the aminoglycoside G-418 Clinical Pharmacy 12:488-505; Wu and Wu, Biotherapy 3:87-95 (1991); Tolstoshev, Ann. Rev. Pharmacol. Toxicol. 32:573-596 (1993); Mulligan, Science 260:926-932 (1993); and Morgan and Anderson, Ann. Rev. Biochem. 62:191-217 (1993); May, 1993, TIB TECH 11(5):155-215); and hygro, which confers resistance to hygromycin (Santerre et al., Gene 30:147 (1984)). Methods commonly known in the art of recombinant DNA technology may be routinely applied to select the desired recombinant clone, and such methods are described, for example, in Ausubel et al. (eds.), Current Protocols in Molecular Biology, John Wiley & Sons, NY (1993); Kriegler, Gene Transfer and Expression, A Laboratory Manual, Stockton Press, NY (1990); and in Chapters 12 and 13, Dracopoli et al. (eds), Current Protocols in Human Genetics, John Wiley & Sons, NY (1994); Colberre-Garapin et al., J. Mol. Biol. 150:1 (1981), which are incorporated by reference herein in their entireties.

The expression levels of an antibody molecule can be increased by vector amplification (for a review, see Bebbington and Hentschel, The use of vectors based on gene amplification for the expression of cloned genes in mammalian cells in DNA cloning, Vol. 3. (Academic Press, New York, 1987)). When a marker in the vector system expressing antibody is amplifiable, increase in the level of inhibitor present in culture of host cell will increase the number of copies of the marker gene. Since the amplified region is associated with the antibody gene, production of the antibody will also increase (Crouse et al., Mol. Cell. Biol. 3:257 (1983)).

The host cell may be co-transfected with two expression vectors of the invention, the first vector encoding a heavy chain derived polypeptide and the second vector encoding a light chain derived polypeptide. The two vectors may contain identical selectable markers which enable equal expression of heavy and light chain polypeptides. Alternatively, a single vector may be used which encodes, and is capable of expressing, both heavy and light chain polypeptides. In such situations, the light chain should be placed before the heavy chain to avoid an excess of toxic free heavy chain (Proudfoot, Nature 322:52 (1986); Kohler, Proc. Natl. Acad. Sci. USA 77:2197 (1980)). The coding sequences for the heavy and light chains may comprise cDNA or genomic DNA.

Once an antibody molecule of the invention has been produced by an animal, chemically synthesized, or recombinantly expressed, it may be purified by any method known in the art for purification of an immunoglobulin molecule, for example, by chromatography (e.g., ion exchange, affinity, particularly by affinity for the specific antigen after Protein A, and sizing column chromatography), centrifugation, differential solubility, or by any other standard technique for the purification of proteins. In addition, the antibodies of the present invention or fragments thereof can be fused to heterologous polypeptide sequences described herein or otherwise known in the art, to facilitate purification.

The present invention encompasses antibodies recombinantly fused or chemically conjugated (including both covalently and non-covalently conjugations) to a polypeptide (or portion thereof, preferably at least 10, 20, 30, 40, 50, 60, 70, 80, 90 or 100 amino acids of the polypeptide) of the present invention to generate fusion proteins. The fusion does not necessarily need to be direct, but may occur through linker sequences. The antibodies may be specific for antigens other than polypeptides (or portion thereof, preferably at least 10, 20, 30, 40, 50, 60, 70, 80, 90 or 100 amino acids of the polypeptide) of the present invention. For example, antibodies may be used to target the polypeptides of the present invention to particular cell types, either in vitro or in vivo, by fusing or conjugating the polypeptides of the present invention to antibodies specific for particular cell surface receptors. Antibodies fused or conjugated to the polypeptides of the present invention may also be used in in vitro immunoassays and purification methods using methods known in the art. See e.g., Harbor et al., supra, and PCT publication WO 93/21232; EP 439,095; Naramura et al., Immunol. Lett. 39:91-99 (1994); U.S. Pat. No. 5,474,981; Gillies et al., PNAS 89:1428-1432 (1992); Fell et al., J. Immunol. 146:2446-2452 (1991), which are incorporated by reference in their entireties.

The present invention further includes compositions comprising the polypeptides of the present invention fused or conjugated to antibody domains other than the variable regions. For example, the polypeptides of the present invention may be fused or conjugated to an antibody Fc region, or portion thereof. The antibody portion fused to a polypeptide of the present invention may comprise the constant region, hinge region, CH1 domain, CH2 domain, and CH3 domain or any combination of whole domains or portions thereof. The polypeptides may also be fused or conjugated to the above antibody portions to form multimers. For example, Fc portions fused to the polypeptides of the present invention can form dimers through disulfide bonding between the Fc portions. Higher multimeric forms can be made by fusing the polypeptides to portions of IgA and IgM. Methods for fusing or conjugating the polypeptides of the present invention to antibody portions are known in the art. See, e.g., U.S. Pat. Nos. 5,336,603; 5,622,929; 5,359,046; 5,349,053; 5,447,851; 5,112,946; EP 307,434; EP 367,166; PCT publications WO 96/04388; WO 91/06570; Ashkenazi et al., Proc. Natl. Acad. Sci. USA 88:10535-10539 (1991); Zheng et al., J. Immunol 154:5590-5600 (1995); and Vil et al., Proc. Natl. Acad. Sci. USA 89:11337-11341 (1992) (said references incorporated by reference in their entireties).

As discussed, supra, the polypeptides corresponding to a polypeptide, polypeptide fragment, or a variant of SEQ ID NO:Y may be fused or conjugated to the above antibody portions to increase the in vivo half life of the polypeptides or for use in immunoassays using methods known in the art. Further, the polypeptides corresponding to SEQ ID NO:Y may be fused or conjugated to the above antibody portions to facilitate purification. One reported example describes chimeric proteins consisting of the first two domains of the human CD4-polypeptide and various domains of the constant regions of the heavy or light chains of mammalian immunoglobulins. (EP 394,827; Traunecker et al., Nature 331:84-86 (1988). The polypeptides of the present invention fused or conjugated to an antibody having disulfide-linked dimeric structures (due to the IgG) may also be more efficient in binding and neutralizing other molecules, than the monomeric secreted protein or protein fragment alone. (Fountoulakis et al., J. Biochem. 270:3958-3964 (1995)). In many cases, the Fc part in a fusion protein is beneficial in therapy and diagnosis, and thus can result in, for example, improved pharmacokinetic properties. (EP A 232,262). Alternatively, deleting the Fc part after the fusion protein has been expressed, detected, and purified, would be desired. For example, the Fc portion may hinder therapy and diagnosis if the fusion protein is used as an antigen for immunizations. In drug discovery, for example, human proteins, such as hIL-5, have been fused with Fc portions for the purpose of high-throughput screening assays to identify antagonists of hIL-5. (See, Bennett et al., J. Molecular Recognition 8:52-58 (1995); Johanson et al., J. Biol. Chem. 270:9459-9471 (1995).

Moreover, the antibodies or fragments thereof of the present invention can be fused to marker sequences, such as a peptide to facilitate purification. In preferred embodiments, the marker amino acid sequence is a hexa-histidine peptide, such as the tag provided in a pQE vector (QIAGEN, Inc., 9259 Eton Avenue, Chatsworth, Calif., 91311), among others, many of which are commercially available. As described in Gentz et al., Proc. Natl. Acad. Sci. USA 86:821-824 (1989), for instance, hexa-histidine provides for convenient purification of the fusion protein. Other peptide tags useful for purification include, but are not limited to, the "HA" tag, which corresponds to an epitope derived from the influenza hemagglutinin protein (Wilson et al., Cell 37:767 (1984)) and the "flag" tag.

The present invention further encompasses antibodies or fragments thereof conjugated to a diagnostic or therapeutic agent. The antibodies can be used diagnostically to, for example, monitor the development or progression of a tumor as part of a clinical testing procedure to, e.g., determine the efficacy of a given treatment regimen. Detection can be facilitated by coupling the antibody to a detectable substance. Examples of detectable substances include various enzymes, prosthetic groups, fluorescent materials, luminescent materials, bioluminescent materials, radioactive materials, positron emitting metals using various positron emission tomographies, and nonradioactive paramagnetic metal ions. The detectable substance may be coupled or conjugated either directly to the antibody (or fragment thereof) or indirectly, through an intermediate (such as, for example, a linker known in the art) using techniques known in the art. See, for example, U.S. Pat. No. 4,741,900 for metal ions which can be conjugated to antibodies for use as diagnostics according to the present invention. Examples of suitable enzymes include horseradish peroxidase, alkaline phosphatase, beta-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin; and examples of suitable radioactive material include 125I, 131I, 111In or 99Tc.

Further, an antibody or fragment thereof may be conjugated to a therapeutic moiety such as a cytotoxin, e.g., a cytostatic or cytocidal agent, a therapeutic agent or a radioactive metal ion, e.g., alpha-emitters such as, for example, 213Bi. A cytotoxin or cytotoxic agent includes any agent that is detrimental to cells. Examples include paclitaxol, cytochalasin B, gramicidin D, ethidium bromide, emetine, mitomycin, etoposide, tenoposide, vincristine, vinblastine, colchicin, doxorubicin, daunorubicin, dihydroxy anthracin dione, mitoxantrone, mithramycin, actinomycin D, 1-dehydrotestosterone, glucocorticoids, procaine, tetracaine, lidocaine, propranolol, and puromycin and analogs or homologs thereof. Therapeutic agents include, but are not limited to, antimetabolites (e.g., methotrexate, 6-mercaptopurine, 6-thioguanine, cytarabine, 5-fluorouracil decarbazine), alkylating agents (e.g., mechlorethamine, thioepa chlorambucil, melphalan, carmustine (BSNU) and lomustine (CCNU), cyclothosphamide, busulfan, dibromomannitol, streptozotocin, mitomycin C, and cis-dichlorodiamine platinum (II) (DDP) cisplatin), anthracyclines (e.g., daunorubicin (formerly daunomycin) and doxorubicin), antibiotics (e.g., dactinomycin (formerly actinomycin), bleomycin, mithramycin, and anthramycin (AMC)), and anti-mitotic agents (e.g., vincristine and vinblastine).

The conjugates of the invention can be used for modifying a given biological response, the therapeutic agent or drug moiety is not to be construed as limited to classical chemical therapeutic agents. For example, the drug moiety may be a protein or polypeptide possessing a desired biological activity. Such proteins may include, for example, a toxin such as abrin, ricin A, pseudomonas exotoxin, or diphtheria toxin; a protein such as tumor necrosis factor, a-interferon, β-interferon, nerve growth factor, platelet derived growth factor, tissue plasminogen activator, an apoptotic agent, e.g., TNF-alpha, TNF-beta, AIM I (See, International Publication No. WO 97/33899), AIM II (See, International Publication No. WO 97/34911), Fas Ligand (Takahashi et al., *Int. Immunol.*, 6:1567-1574 (1994)), VEGI (See, International Publication No. WO 99/23105), a thrombotic agent or an anti-angiogenic agent, e.g., angiostatin or endostatin; or, biological response modifiers such as, for example, lymphokines, interleukin-1 ("IL-1"), interleukin-2 ("IL-2"), interleukin-6 ("IL-6"), granulocyte macrophage colony stimulating factor ("GM-CSF"), granulocyte colony stimulating factor ("G-CSF"), or other growth factors.

Antibodies may also be attached to solid supports, which are particularly useful for immunoassays or purification of the target antigen. Such solid supports include, but are not limited to, glass, cellulose, polyacrylamide, nylon, polystyrene, polyvinyl chloride or polypropylene.

Techniques for conjugating such therapeutic moiety to antibodies are well known, see, e.g., Amon et al., "Monoclonal Antibodies For Immunotargeting Of Drugs In Cancer Therapy", in Monoclonal Antibodies And Cancer Therapy, Reisfeld et al. (eds.), pp. 243-56 (Alan R. Liss, Inc. 1985); Hellstrom et al., "Antibodies For Drug Delivery", in Controlled Drug Delivery (2nd Ed.), Robinson et al. (eds.), pp. 623-53 (Marcel Dekker, Inc. 1987); Thorpe, "Antibody Carriers Of Cytotoxic Agents In Cancer Therapy: A Review", in Monoclonal Antibodies '84: Biological And Clinical Applications, Pinchera et al. (eds.), pp. 475-506 (1985); "Analysis, Results, And Future Prospective Of The Therapeutic Use Of Radiolabeled Antibody In Cancer Therapy", in Monoclonal Antibodies For Cancer Detection And Therapy, Baldwin et al. (eds.), pp. 303-16 (Academic Press 1985), and Thorpe et al., "The Preparation And Cytotoxic Properties Of Antibody-Toxin Conjugates", Immunol Rev. 62:119-58 (1982).

Alternatively, an antibody can be conjugated to a second antibody to form an antibody heteroconjugate as described by Segal in U.S. Pat. No. 4,676,980, which is incorporated herein by reference in its entirety.

An antibody, with or without a therapeutic moiety conjugated to it, administered alone or in combination with cytotoxic factor(s) and/or cytokine(s) can be used as a therapeutic.

Immunophenotyping

The antibodies of the invention may be utilized for immunophenotyping of cell lines and biological samples. The translation product of the gene of the present invention may be useful as a cell specific marker, or more specifically as a cellular marker that is differentially expressed at various stages of differentiation and/or maturation of particular cell types. Monoclonal antibodies directed against a specific epitope, or combination of epitopes, will allow for the screening of cellular populations expressing the marker. Various techniques can be utilized using monoclonal antibodies to screen for cellular populations expressing the marker(s), and include magnetic separation using antibody-coated magnetic beads, "panning" with antibody attached to a solid matrix (i.e., plate), and flow cytometry (See, e.g., U.S. Pat. No. 5,985,660; and Morrison et al., Cell, 96:737-49 (1999)).

These techniques allow for the screening of particular populations of cells, such as might be found with hematological malignancies (i.e. minimal residual disease (MRD) in acute leukemic patients) and "non-self" cells in transplantations to prevent Graft-versus-Host Disease (GVHD). Alternatively, these techniques allow for the screening of hematopoietic stem and progenitor cells capable of undergoing proliferation and/or differentiation, as might be found in human umbilical cord blood.

Assays For Antibody Binding

The antibodies of the invention may be assayed for immunospecific binding by any method known in the art. The immunoassays which can be used include but are not limited to competitive and non-competitive assay systems using techniques such as western blots, radioimmunoassays, ELISA (enzyme linked immunosorbent assay), "sandwich" immunoassays, immunoprecipitation assays, precipitin reactions, gel diffusion precipitin reactions, immunodiffusion assays, agglutination assays, complement-fixation assays, immunoradiometric assays, fluorescent immunoassays, protein A immunoassays, to name but a few. Such assays are routine and well known in the art (see, e.g., Ausubel et al, eds, 1994, Current Protocols in Molecular Biology, Vol. 1, John Wiley & Sons, Inc., New York, which is incorporated by reference herein in its entirety). Exemplary immunoassays are described briefly below (but are not intended by way of limitation).

Immunoprecipitation protocols generally comprise lysing a population of cells in a lysis buffer such as RIPA buffer (1% NP-40 or Triton X-100, 1% sodium deoxycholate, 0.1% SDS, 0.15 M NaCl, 0.01 M sodium phosphate at pH 7.2, 1% Trasylol) supplemented with protein phosphatase and/or protease inhibitors (e.g., EDTA, PMSF, aprotinin, sodium vanadate), adding the antibody of interest to the cell lysate, incubating for a period of time (e.g., 1-4 hours) at 4° C., adding protein A and/or protein G sepharose beads to the cell lysate, incubating for about an hour or more at 4° C., washing the beads in lysis buffer and resuspending the beads in SDS/sample buffer. The ability of the antibody of interest to immunoprecipitate a particular antigen can be assessed by, e.g., western blot analysis. One of skill in the art would be knowledgeable as to the parameters that can be modified to increase the binding of the antibody to an antigen and decrease the background (e.g., pre-clearing the cell lysate with sepharose beads). For further discussion regarding immunoprecipitation protocols see, e.g., Ausubel et al, eds, 1994, Current Protocols in Molecular Biology, Vol. 1, John Wiley & Sons, Inc., New York at 10.16.1.

Western blot analysis generally comprises preparing protein samples, electrophoresis of the protein samples in a polyacrylamide gel (e.g., 8%-20% SDS-PAGE depending on the molecular weight of the antigen), transferring the protein sample from the polyacrylamide gel to a membrane such as nitrocellulose, PVDF or nylon, blocking the membrane in blocking solution (e.g., PBS with 3% BSA or non-fat milk), washing the membrane in washing buffer (e.g., PBS-Tween 20), blocking the membrane with primary antibody (the antibody of interest) diluted in blocking buffer, washing the membrane in washing buffer, blocking the membrane with a secondary antibody (which recognizes the primary antibody, e.g., an anti-human antibody) conjugated to an enzymatic substrate (e.g., horseradish peroxidase or alkaline phosphatase) or radioactive molecule (e.g., $^{32}$P or 125I) diluted in blocking buffer, washing the membrane in wash buffer, and detecting the presence of the antigen. One of skill in the art would be knowledgeable as to the parameters that can be modified to increase the signal detected and to reduce the background noise. For further discussion regarding western blot protocols see, e.g., Ausubel et al, eds, 1994, Current Protocols in Molecular Biology, Vol. 1, John Wiley & Sons, Inc., New York at 10.8.1.

ELISAs comprise preparing antigen, coating the well of a 96 well microtiter plate with the antigen, adding the antibody of interest conjugated to a detectable compound such as an enzymatic substrate (e.g., horseradish peroxidase or alkaline phosphatase) to the well and incubating for a period of time, and detecting the presence of the antigen. In ELISAs the antibody of interest does not have to be conjugated to a detectable compound; instead, a second antibody (which recognizes the antibody of interest) conjugated to a detectable compound may be added to the well. Further, instead of coating the well with the antigen, the antibody may be coated to the well. In this case, a second antibody conjugated to a detectable compound may be added following the addition of the antigen of interest to the coated well. One of skill in the art would be knowledgeable as to the parameters that can be modified to increase the signal detected as well as other variations of ELISAs known in the art. For further discussion regarding ELISAs see, e.g., Ausubel et al, eds, 1994, Current Protocols in Molecular Biology, Vol. 1, John Wiley & Sons, Inc., New York at 11.2.1.

The binding affinity of an antibody to an antigen and the off-rate of an antibody-antigen interaction can be determined by competitive binding assays. One example of a competitive binding assay is a radioimmunoassay comprising the incubation of labeled antigen (e.g., 3H or 125I) with the antibody of interest in the presence of increasing amounts of unlabeled antigen, and the detection of the antibody bound to the labeled antigen. The affinity of the antibody of interest for a particular antigen and the binding off-rates can be determined from the data by scatchard plot analysis. Competition with a second antibody can also be determined using radioimmunoassays. In this case, the antigen is incubated with antibody of interest conjugated to a labeled compound (e.g., 3H or 125I) in the presence of increasing amounts of an unlabeled second antibody.

Therapeutic Uses

The present invention is further directed to antibody-based therapies which involve administering antibodies of the invention to an animal, preferably a mammal, and most preferably a human, patient for treating one or more of the disclosed diseases, disorders, or conditions. Therapeutic compounds of the invention include, but are not limited to, antibodies of the invention (including fragments, analogs and derivatives thereof as described herein) and nucleic acids encoding antibodies of the invention (including fragments, analogs and derivatives thereof and anti-idiotypic antibodies as described herein). The antibodies of the invention can be used to treat, inhibit or prevent diseases, disorders or conditions associated with aberrant expression and/or activity of a polypeptide of the invention, including, but not limited to, any one or more of the diseases, disorders, or conditions described herein. The treatment and/or prevention of diseases, disorders, or conditions associated with aberrant expression and/or activity of a polypeptide of the invention includes, but is not limited to, alleviating symptoms associated with those diseases, disorders or conditions. Antibodies of the invention may be provided in pharmaceutically acceptable compositions as known in the art or as described herein.

A summary of the ways in which the antibodies of the present invention may be used therapeutically includes binding polynucleotides or polypeptides of the present invention locally or systemically in the body or by direct cytotoxicity of the antibody, e.g. as mediated by complement (CDC) or by effector cells (ADCC). Some of these approaches are described in more detail below. Armed with the teachings provided herein, one of ordinary skill in the art will know how to use the antibodies of the present invention for diagnostic, monitoring or therapeutic purposes without undue experimentation.

The antibodies of this invention may be advantageously utilized in combination with other monoclonal or chimeric antibodies, or with lymphokines or hematopoietic growth factors (such as, e.g., IL-2, IL-3 and IL-7), for example, which serve to increase the number or activity of effector cells which interact with the antibodies.

The antibodies of the invention may be administered alone or in combination with other types of treatments (e.g., radiation therapy, chemotherapy, hormonal therapy, immunotherapy and anti-tumor agents). Generally, administration of products of a species origin or species reactivity (in the case of antibodies) that is the same species as that of the patient is preferred. Thus, in a preferred embodiment, human antibodies, fragments derivatives, analogs, or nucleic acids, are administered to a human patient for therapy or prophylaxis.

It is preferred to use high affinity and/or potent in vivo inhibiting and/or neutralizing antibodies against polypeptides or polynucleotides of the present invention, fragments or regions thereof, for both immunoassays directed to and therapy of disorders related to polynucleotides or polypeptides, including fragments thereof, of the present invention. Such antibodies, fragments, or regions, will preferably have an affinity for polynucleotides or polypeptides of the invention, including fragments thereof. Preferred binding affinities include those with a dissociation constant or Kd less than $5 \times 10^{-2}$ M, $10^{-2}$ M, $5 \times 10^{-3}$ M, $10^{-3}$ M, $5 \times 10^{-4}$ M, $10^{-4}$ M, $5 \times 10^{-5}$ M, $10^{-5}$ M, $5 \times 10^{-6}$ M, $10^{-6}$ M, $5 \times 10^{-7}$ M, $10^{-7}$ M, $5 \times 10^{-8}$ M, $10^{-8}$ M, $5 \times 10^{-9}$ M, $10^{-9}$ M, $5 \times 10^{-10}$ M, $10^{-10}$, $5 \times 10^{-11}$ M, $10^{-11}$ M, $5 \times 10^{-12}$ M, $10^{-12}$ M, $5 \times 10^{-13}$ M, $10^{-13}$ M, $5 \times 10^{-14}$ M, $10^{-14}$ M, $5 \times 10^{-15}$ M, and $10^{-15}$ M.

Gene Therapy

In a specific embodiment, nucleic acids comprising sequences encoding antibodies or functional derivatives thereof, are administered to treat, inhibit or prevent a disease or disorder associated with aberrant expression and/or activity of a polypeptide of the invention, by way of gene therapy. Gene therapy refers to therapy performed by the administration to a subject of an expressed or expressible nucleic acid. In this embodiment of the invention, the nucleic acids produce their encoded protein that mediates a therapeutic effect.

Any of the methods for gene therapy available in the art can be used according to the present invention. Exemplary methods are described below.

For general reviews of the methods of gene therapy, see Goldspiel et al., Clinical Pharmacy 12:488-505 (1993); Wu and Wu, Biotherapy 3:87-95 (1991); Tolstoshev, Ann. Rev. Pharmacol. Toxicol. 32:573-596 (1993); Mulligan, Science 260:926-932 (1993); and Morgan and Anderson, Ann. Rev. Biochem. 62:191-217 (1993); May, TIBTECH 11(5):155-215 (1993). Methods commonly known in the art of recombinant DNA technology which can be used are described in Ausubel et al. (eds.), Current Protocols in Molecular Biology, John Wiley & Sons, NY (1993); and Kriegler, Gene Transfer and Expression, A Laboratory Manual, Stockton Press, NY (1990).

In a preferred aspect, the compound comprises nucleic acid sequences encoding an antibody, said nucleic acid sequences being part of expression vectors that express the antibody or fragments or chimeric proteins or heavy or light chains thereof in a suitable host. In particular, such nucleic acid sequences have promoters operably linked to the antibody coding region, said promoter being inducible or constitutive, and, optionally, tissue-specific. In another particular embodiment, nucleic acid molecules are used in which the antibody coding sequences and any other desired sequences are flanked by regions that promote homologous recombination at a desired site in the genome, thus providing for intrachromosomal expression of the antibody encoding nucleic acids (Koller and Smithies, Proc. Natl. Acad. Sci. USA 86:8932-8935 (1989); Zijlstra et al., Nature 342:435-438 (1989). In specific embodiments, the expressed antibody molecule is a single chain antibody; alternatively, the nucleic acid sequences include sequences encoding both the heavy and light chains, or fragments thereof, of the antibody.

Delivery of the nucleic acids into a patient may be either direct, in which case the patient is directly exposed to the nucleic acid or nucleic acid-carrying vectors, or indirect, in which case, cells are first transformed with the nucleic acids in vitro, then transplanted into the patient. These two approaches are known, respectively, as in vivo or ex vivo gene therapy.

In a specific embodiment, the nucleic acid sequences are directly administered in vivo, where it is expressed to produce the encoded product. This can be accomplished by any of numerous methods known in the art, e.g., by constructing them as part of an appropriate nucleic acid expression vector and administering it so that they become intracellular, e.g., by infection using defective or attenuated retrovirals or other viral vectors (see U.S. Pat. No. 4,980,286), or by direct injection of naked DNA, or by use of microparticle bombardment (e.g., a gene gun; Biolistic, Dupont), or coating with lipids or cell-surface receptors or transfecting agents, encapsulation in liposomes, microparticles, or microcapsules, or by administering them in linkage to a peptide which is known to enter the nucleus, by administering it in linkage to a ligand subject to receptor-mediated endocytosis (see, e.g., Wu and Wu, J. Biol. Chem. 262:4429-4432 (1987)) (which can be used to target cell types specifically expressing the receptors), etc. In another embodiment, nucleic acid-ligand complexes can be formed in which the ligand comprises a fusogenic viral peptide to disrupt endosomes, allowing the nucleic acid to avoid lysosomal degradation. In yet another embodiment, the nucleic acid can be targeted in vivo for cell specific uptake and expression, by targeting a specific receptor (see, e.g., PCT Publications WO 92/06180; WO 92/22635; WO92/20316; WO93/14188, WO 93/20221). Alternatively, the nucleic acid can be introduced intracellularly and incorporated within host cell DNA for expression, by homologous recombination (Koller and Smithies, Proc. Natl. Acad. Sci. USA 86:8932-8935 (1989); Zijlstra et al., Nature 342:435-438 (1989)).

In a specific embodiment, viral vectors that contains nucleic acid sequences encoding an antibody of the invention are used. For example, a retroviral vector can be used (see Miller et al., Meth. Enzymol. 217:581-599 (1993)). These retroviral vectors contain the components necessary for the correct packaging of the viral genome and integration into the host cell DNA. The nucleic acid sequences encoding the antibody to be used in gene therapy are cloned into one or more vectors, which facilitates delivery of the gene into a patient. More detail about retroviral vectors can be found in Boesen et al., Biotherapy 6:291-302 (1994), which describes the use of a retroviral vector to deliver the mdr1 gene to hematopoietic stem cells in order to make the stem cells more resistant to chemotherapy. Other references illustrating the use of retroviral vectors in gene therapy are: Clowes et al., J. Clin. Invest. 93:644-651 (1994); Kiem et al., Blood 83:1467-1473 (1994); Salmons and Gunzberg, Human Gene Therapy 4:129-141 (1993); and Grossman and Wilson, Curr. Opin. in Genetics and Devel. 3:110-114 (1993).

Adenoviruses are other viral vectors that can be used in gene therapy. Adenoviruses are especially attractive vehicles for delivering genes to respiratory epithelia. Adenoviruses naturally infect respiratory epithelia where they cause a mild disease. Other targets for adenovirus-based delivery systems are liver, the central nervous system, endothelial cells, and muscle. Adenoviruses have the advantage of being capable of infecting non-dividing cells. Kozarsky and Wilson, Current Opinion in Genetics and Development 3:499-503 (1993) present a review of adenovirus-based gene therapy. Bout et al., Human Gene Therapy 5:3-10 (1994) demonstrated the use of adenovirus vectors to transfer genes to the respiratory epithelia of rhesus monkeys. Other instances of the use of adenoviruses in gene therapy can be found in Rosenfeld et al., Science 252:431-434 (1991); Rosenfeld et al., Cell 68:143-155 (1992); Mastrangeli et al., J. Clin. Invest. 91:225-234 (1993); PCT Publication WO94/12649; and Wang, et al., Gene Therapy 2:775-783 (1995). In a preferred embodiment, adenovirus vectors are used.

Adeno-associated virus (AAV) has also been proposed for use in gene therapy (Walsh et al., Proc. Soc. Exp. Biol. Med. 204:289-300 (1993); U.S. Pat. No. 5,436,146).

Another approach to gene therapy involves transferring a gene to cells in tissue culture by such methods as electroporation, lipofection, calcium phosphate mediated transfection, or viral infection. Usually, the method of transfer includes the transfer of a selectable marker to the cells. The cells are then placed under selection to isolate those cells that have taken up and are expressing the transferred gene. Those cells are then delivered to a patient.

In this embodiment, the nucleic acid is introduced into a cell prior to administration in vivo of the resulting recombinant cell. Such introduction can be carried out by any method known in the art, including but not limited to transfection, electroporation, microinjection, infection with a viral or bacteriophage vector containing the nucleic acid sequences, cell fusion, chromosome-mediated gene transfer, microcell-mediated gene transfer, spheroplast fusion, etc. Numerous techniques are known in the art for the introduction of foreign genes into cells (see, e.g., Loeffler and Behr, Meth. Enzymol. 217:599-618 (1993); Cohen et al., Meth. Enzymol. 217:618-644 (1993); Cline, Pharmac. Ther. 29:69-92m (1985) and may be used in accordance with the present invention, provided that the necessary developmental and physiological functions of the recipient cells are not disrupted. The technique should provide for the stable transfer of the nucleic acid to the cell, so that the nucleic acid is expressible by the cell and preferably heritable and expressible by its cell progeny.

The resulting recombinant cells can be delivered to a patient by various methods known in the art. Recombinant blood cells (e.g., hematopoietic stem or progenitor cells) are preferably administered intravenously. The amount of cells envisioned for use depends on the desired effect, patient state, etc., and can be determined by one skilled in the art.

Cells into which a nucleic acid can be introduced for purposes of gene therapy encompass any desired, available cell type, and include but are not limited to epithelial cells, endothelial cells, keratinocytes, fibroblasts, muscle cells, hepatocytes; blood cells such as Tlymphocytes, Blymphocytes, monocytes, macrophages, neutrophils, eosinophils, megakaryocytes, granulocytes; various stem or progenitor cells, in particular hematopoietic stem or progenitor cells, e.g., as obtained from bone marrow, umbilical cord blood, peripheral blood, fetal liver, etc.

In a preferred embodiment, the cell used for gene therapy is autologous to the patient.

In an embodiment in which recombinant cells are used in gene therapy, nucleic acid sequences encoding an antibody are introduced into the cells such that they are expressible by the cells or their progeny, and the recombinant cells are then administered in vivo for therapeutic effect. In a specific embodiment, stem or progenitor cells are used. Any stem and/or progenitor cells which can be isolated and maintained in vitro can potentially be used in accordance with this embodiment of the present invention (see e.g. PCT Publication WO 94/08598; Stemple and Anderson, *Cell* 71:973-985 (1992); Rheinwald, Meth. Cell Bio. 21A:229 (1980); and Pittelkow and Scott, Mayo Clinic Proc. 61:771 (1986)).

In a specific embodiment, the nucleic acid to be introduced for purposes of gene therapy comprises an inducible promoter operably linked to the coding region, such that expression of the nucleic acid is controllable by controlling the presence or absence of the appropriate inducer of transcription.

Demonstration of Therapeutic or Prophylactic Activity

The compounds or pharmaceutical compositions of the invention are preferably tested in vitro, and then in vivo for the desired therapeutic or prophylactic activity, prior to use in humans. For example, in vitro assays to demonstrate the therapeutic or prophylactic utility of a compound or pharmaceutical composition include, the effect of a compound on a cell line or a patient tissue sample. The effect of the compound or composition on the cell line and/or tissue sample can be determined utilizing techniques known to those of skill in the art including, but not limited to, rosette formation assays and cell lysis assays. In accordance with the invention, in vitro assays which can be used to determine whether administration of a specific compound is indicated, include in vitro cell culture assays in which a patient tissue sample is grown in culture, and exposed to or otherwise administered a compound, and the effect of such compound upon the tissue sample is observed.

Therapeutic/Prophylactic Administration and Composition

The invention provides methods of treatment, inhibition and prophylaxis by administration to a subject of an effective amount of a compound or pharmaceutical composition of the invention, preferably an antibody of the invention. In a preferred aspect, the compound is substantially purified (e.g., substantially free from substances that limit its effect or produce undesired side-effects). The subject is preferably an animal, including but not limited to animals such as cows, pigs, horses, chickens, cats, dogs, etc., and is preferably a mammal, and most preferably human.

Formulations and methods of administration that can be employed when the compound comprises a nucleic acid or an immunoglobulin are described above; additional appropriate formulations and routes of administration can be selected from among those described herein below.

Various delivery systems are known and can be used to administer a compound of the invention, e.g., encapsulation in liposomes, microparticles, microcapsules, recombinant cells capable of expressing the compound, receptor-mediated endocytosis (see, e.g., Wu and Wu, J. Biol. Chem. 262:4429-4432 (1987)), construction of a nucleic acid as part of a retroviral or other vector, etc. Methods of introduction include but are not limited to intradermal, intramuscular, intraperitoneal, intravenous, subcutaneous, intranasal, epidural, and oral routes. The compounds or compositions may be administered by any convenient route, for example by infusion or bolus injection, by absorption through epithelial or mucocutaneous linings (e.g., oral mucosa, rectal and intestinal mucosa, etc.) and may be administered together with other biologically active agents. Administration can be systemic or local. In addition, it may be desirable to introduce the pharmaceutical compounds or compositions of the invention into the central nervous system by any suitable route, including intraventricular and intrathecal injection; intraventricular injection may be facilitated by an intraventricular catheter, for example, attached to a reservoir, such as an Ommaya reservoir. Pulmonary administration can also be employed, e.g., by use of an inhaler or nebulizer, and formulation with an aerosolizing agent.

In a specific embodiment, it may be desirable to administer the pharmaceutical compounds or compositions of the invention locally to the area in need of treatment; this may be achieved by, for example, and not by way of limitation, local infusion during surgery, topical application, e.g., in conjunction with a wound dressing after surgery, by injection, by means of a catheter, by means of a suppository, or by means of an implant, said implant being of a porous, non-porous, or gelatinous material, including membranes, such as sialastic membranes, or fibers. Preferably, when administering a protein, including an antibody, of the invention, care must be taken to use materials to which the protein does not absorb.

In another embodiment, the compound or composition can be delivered in a vesicle, in particular a liposome (see Langer, Science 249:1527-1533 (1990); Treat et al., in Liposomes in the Therapy of Infectious Disease and Cancer, Lopez-Berestein and Fidler (eds.), Liss, New York, pp. 353-365 (1989); Lopez-Berestein, ibid., pp. 317-327; see generally ibid.)

In yet another embodiment, the compound or composition can be delivered in a controlled release system. In one embodiment, a pump may be used (see Langer, supra; Sefton, CRC Crit. Ref. Biomed. Eng. 14:201 (1987); Buchwald et al., Surgery 88:507 (1980); Saudek et al., N. Engl. J. Med. 321: 574 (1989)). In another embodiment, polymeric materials can be used (see Medical Applications of Controlled Release, Langer and Wise (eds.), CRC Pres., Boca Raton, Fla. (1974); Controlled Drug Bioavailability, Drug Product Design and Performance, Smolen and Ball (eds.), Wiley, New York (1984); Ranger and Peppas, J., Macromol. Sci. Rev. Macromol. Chem. 23:61 (1983); see also Levy et al., Science 228: 190 (1985); During et al., Ann. Neurol. 25:351 (1989); Howard et al., J. Neurosurg. 71:105 (1989)). In yet another embodiment, a controlled release system can be placed in proximity of the therapeutic target, i.e., the brain, thus requiring only a fraction of the systemic dose (see, e.g., Goodson, in Medical Applications of Controlled Release, supra, vol. 2, pp. 115-138 (1984)).

Other controlled release systems are discussed in the review by Langer (Science 249:1527-1533 (1990)).

In a specific embodiment where the compound of the invention is a nucleic acid encoding a protein, the nucleic acid can be administered in vivo to promote expression of its encoded protein, by constructing it as part of an appropriate nucleic acid expression vector and administering it so that it becomes intracellular, e.g., by use of a retroviral vector (see U.S. Pat. No. 4,980,286), or by direct injection, or by use of microparticle bombardment (e.g., a gene gun; Biolistic, Dupont), or coating with lipids or cell-surface receptors or transfecting agents, or by administering it in linkage to a homeobox-like peptide which is known to enter the nucleus (see e.g., Joliot et al., Proc. Natl. Acad. Sci. USA 88:1864-1868 (1991)), etc. Alternatively, a nucleic acid can be introduced intracellularly and incorporated within host cell DNA for expression, by homologous recombination.

The present invention also provides pharmaceutical compositions. Such compositions comprise a therapeutically effective amount of a compound, and a pharmaceutically acceptable carrier. In a specific embodiment, the term "pharmaceutically acceptable" means approved by a regulatory agency of the Federal or a state government or listed in the U.S. Pharmacopeia or other generally recognized pharmacopeia for use in animals, and more particularly in humans. The term "carrier" refers to a diluent, adjuvant, excipient, or vehicle with which the therapeutic is administered. Such pharmaceutical carriers can be sterile liquids, such as water and oils, including those of petroleum, animal, vegetable or synthetic origin, such as peanut oil, soybean oil, mineral oil, sesame oil and the like. Water is a preferred carrier when the pharmaceutical composition is administered intravenously. Saline solutions and aqueous dextrose and glycerol solutions can also be employed as liquid carriers, particularly for injectable solutions. Suitable pharmaceutical excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like. The composition, if desired, can also contain minor amounts of wetting or emulsifying agents, or pH buffering agents. These compositions can take the form of solutions, suspensions, emulsion, tablets, pills, capsules, powders, sustained-release formulations and the like. The composition can be formulated as a suppository, with traditional binders and carriers such as triglycerides. Oral formulation can include standard carriers such as pharmaceutical grades of mannitol, lactose, starch, magnesium stearate, sodium saccharine, cellulose, magnesium carbonate, etc. Examples of suitable pharmaceutical carriers are described in "Remington's Pharmaceutical Sciences" by E.W. Martin. Such compositions will contain a therapeutically effective amount of the compound, preferably in purified form, together with a suitable amount of carrier so as to provide the form for proper administration to the patient. The formulation should suit the mode of administration.

In a preferred embodiment, the composition is formulated in accordance with routine procedures as a pharmaceutical composition adapted for intravenous administration to human beings. Typically, compositions for intravenous administration are solutions in sterile isotonic aqueous buffer. Where necessary, the composition may also include a solubilizing agent and a local anesthetic such as lignocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the composition is to be administered by infusion, it can be dispensed with an infusion bottle containing sterile pharmaceutical grade water or saline. Where the composition is administered by injection, an ampoule of sterile water for injection or saline can be provided so that the ingredients may be mixed prior to administration.

The compounds of the invention can be formulated as neutral or salt forms. Pharmaceutically acceptable salts include those formed with anions such as those derived from hydrochloric, phosphoric, acetic, oxalic, tartaric acids, etc., and those formed with cations such as those derived from sodium, potassium, ammonium, calcium, ferric hydroxides, isopropylamine, triethylamine, 2-ethylamino ethanol, histidine, procaine, etc.

The amount of the compound of the invention which will be effective in the treatment, inhibition and prevention of a disease or disorder associated with aberrant expression and/or activity of a polypeptide of the invention can be determined by standard clinical techniques. In addition, in vitro assays may optionally be employed to help identify optimal dosage ranges. The precise dose to be employed in the formulation will also depend on the route of administration, and the seriousness of the disease or disorder, and should be decided according to the judgment of the practitioner and each patient's circumstances. Effective doses may be extrapolated from dose-response curves derived from in vitro or animal model test systems.

For antibodies, the dosage administered to a patient is typically 0.1 mg/kg to 100 mg/kg of the patient's body weight. Preferably, the dosage administered to a patient is between 0.1 mg/kg and 20 mg/kg of the patient's body weight, more preferably 1 mg/kg to 10 mg/kg of the patient's body weight. Generally, human antibodies have a longer half-life within the human body than antibodies from other species due to the immune response to the foreign polypeptides. Thus, lower dosages of human antibodies and less frequent administration is often possible. Further, the dosage and frequency of administration of antibodies of the invention may be reduced by enhancing uptake and tissue penetration (e.g., into the brain) of the antibodies by modifications such as, for example, lipidation.

The invention also provides a pharmaceutical pack or kit comprising one or more containers filled with one or more of the ingredients of the pharmaceutical compositions of the invention. Optionally associated with such container(s) can be a notice in the form prescribed by a governmental agency regulating the manufacture, use or sale of pharmaceuticals or biological products, which notice reflects approval by the agency of manufacture, use or sale for human administration.

Diagnosis and Imaging

Labeled antibodies, and derivatives and analogs thereof, which specifically bind to a polypeptide of interest can be used for diagnostic purposes to detect, diagnose, or monitor diseases, disorders, and/or conditions associated with the aberrant expression and/or activity of a polypeptide of the invention. The invention provides for the detection of aberrant expression of a polypeptide of interest, comprising (a) assaying the expression of the polypeptide of interest in cells or body fluid of an individual using one or more antibodies specific to the polypeptide interest and (b) comparing the level of gene expression with a standard gene expression level, whereby an increase or decrease in the assayed polypeptide gene expression level compared to the standard expression level is indicative of aberrant expression.

The invention provides a diagnostic assay for diagnosing a disorder, comprising (a) assaying the expression of the polypeptide of interest in cells or body fluid of an individual using one or more antibodies specific to the polypeptide interest and (b) comparing the level of gene expression with a standard gene expression level, whereby an increase or decrease in the assayed polypeptide gene expression level compared to the standard expression level is indicative of a particular disorder. With respect to cancer, the presence of a relatively high amount of transcript in biopsied tissue from an individual may indicate a predisposition for the development of the disease, or may provide a means for detecting the disease prior to the appearance of actual clinical symptoms. A more definitive diagnosis of this type may allow health professionals to employ preventative measures or aggressive treatment earlier thereby preventing the development or further progression of the cancer.

Antibodies of the invention can be used to assay protein levels in a biological sample using classical immunohistological methods known to those of skill in the art (e.g., see Jalkanen, et al., J. Cell. Biol. 101:976-985 (1985); Jalkanen, et al., J. Cell. Biol. 105:3087-3096 (1987)). Other antibody-based methods useful for detecting protein gene expression include immunoassays, such as the enzyme linked immunosorbent assay (ELISA) and the radioimmunoassay (RIA). Suitable antibody assay labels are known in the art and include enzyme labels, such as, glucose oxidase; radioisotopes, such as iodine (125I, 121I), carbon (14C), sulfur (35S), tritium (3H), indium (112In), and technetium (99Tc); luminescent labels, such as luminol; and fluorescent labels, such as fluorescein and rhodamine, and biotin.

One aspect of the invention is the detection and diagnosis of a disease or disorder associated with aberrant expression of a polypeptide of interest in an animal, preferably a mammal and most preferably a human. In one embodiment, diagnosis comprises: a) administering (for example, parenterally, subcutaneously, or intraperitoneally) to a subject an effective amount of a labeled molecule which specifically binds to the polypeptide of interest; b) waiting for a time interval following the administering for permitting the labeled molecule to preferentially concentrate at sites in the subject where the polypeptide is expressed (and for unbound labeled molecule to be cleared to background level); c) determining background level; and d) detecting the labeled molecule in the subject, such that detection of labeled molecule above the background level indicates that the subject has a particular disease or disorder associated with aberrant expression of the polypeptide of interest. Background level can be determined by various methods including, comparing the amount of labeled molecule detected to a standard value previously determined for a particular system.

It will be understood in the art that the size of the subject and the imaging system used will determine the quantity of imaging moiety needed to produce diagnostic images. In the case of a radioisotope moiety, for a human subject, the quantity of radioactivity injected will normally range from about 5 to 20 millicuries of 99 mTc. The labeled antibody or antibody fragment will then preferentially accumulate at the location of cells which contain the specific protein. In vivo tumor imaging is described in S. W. Burchiel et al., "Immunopharmacokinetics of Radiolabeled Antibodies and Their Fragments." (Chapter 13 in Tumor Imaging: The Radiochemical Detection of Cancer, S.W. Burchiel and B. A. Rhodes, eds., Masson Publishing Inc. (1982).

Depending on several variables, including the type of label used and the mode of administration, the time interval following the administration for permitting the labeled molecule to preferentially concentrate at sites in the subject and for unbound labeled molecule to be cleared to background level is 6 to 48 hours or 6 to 24 hours or 6 to 12 hours. In another embodiment the time interval following administration is 5 to 20 days or 5 to 10 days.

In an embodiment, monitoring of the disease or disorder is carried out by repeating the method for diagnosing the disease or disease, for example, one month after initial diagnosis, six months after initial diagnosis, one year after initial diagnosis, etc.

Presence of the labeled molecule can be detected in the patient using methods known in the art for in vivo scanning. These methods depend upon the type of label used. Skilled artisans will be able to determine the appropriate method for detecting a particular label. Methods and devices that may be used in the diagnostic methods of the invention include, but are not limited to, computed tomography (CT), whole body scan such as position emission tomography (PET), magnetic resonance imaging (MRI), and sonography.

In a specific embodiment, the molecule is labeled with a radioisotope and is detected in the patient using a radiation responsive surgical instrument (Thurston et al., U.S. Pat. No. 5,441,050). In another embodiment, the molecule is labeled with a fluorescent compound and is detected in the patient using a fluorescence responsive scanning instrument. In another embodiment, the molecule is labeled with a positron emitting metal and is detected in the patent using positron emission-tomography. In yet another embodiment, the molecule is labeled with a paramagnetic label and is detected in a patient using magnetic resonance imaging (MRI).

Kits

The present invention provides kits that can be used in the above methods. In one embodiment, a kit comprises an antibody of the invention, preferably a purified antibody, in one or more containers. In a specific embodiment, the kits of the present invention contain a substantially isolated polypeptide comprising an epitope which is specifically immunoreactive with an antibody included in the kit. Preferably, the kits of the present invention further comprise a control antibody which does not react with the polypeptide of interest. In another specific embodiment, the kits of the present invention contain a means for detecting the binding of an antibody to a polypeptide of interest (e.g., the antibody may be conjugated to a detectable substrate such as a fluorescent compound, an enzymatic substrate, a radioactive compound or a luminescent compound, or a second antibody which recognizes the first antibody may be conjugated to a detectable substrate).

In another specific embodiment of the present invention, the kit is a diagnostic kit for use in screening serum containing antibodies specific against proliferative and/or cancerous polynucleotides and polypeptides. Such a kit may include a control antibody that does not react with the polypeptide of interest. Such a kit may include a substantially isolated polypeptide antigen comprising an epitope which is specifically immunoreactive with at least one anti-polypeptide antigen antibody. Further, such a kit includes means for detecting the binding of said antibody to the antigen (e.g., the antibody may be conjugated to a fluorescent compound such as fluorescein or rhodamine which can be detected by flow cytometry). In specific embodiments, the kit may include a recombinantly produced or chemically synthesized polypeptide antigen. The polypeptide antigen of the kit may also be attached to a solid support.

In a more specific embodiment the detecting means of the above-described kit includes a solid support to which said polypeptide antigen is attached. Such a kit may also include a non-attached reporter-labeled anti-human antibody. In this embodiment, binding of the antibody to the polypeptide antigen can be detected by binding of the said reporter-labeled antibody.

In an additional embodiment, the invention includes a diagnostic kit for use in screening serum containing antigens of the polypeptide of the invention. The diagnostic kit includes a substantially isolated antibody specifically immunoreactive with polypeptide or polynucleotide antigens, and means for detecting the binding of the polynucleotide or polypeptide antigen to the antibody. In one embodiment, the antibody is attached to a solid support. In a specific embodiment, the antibody may be a monoclonal antibody. The detecting means of the kit may include a second, labeled monoclonal antibody. Alternatively, or in addition, the detecting means may include a labeled, competing antigen.

In one diagnostic configuration, test serum is reacted with a solid phase reagent having a surface-bound antigen obtained by the methods of the present invention. After binding with specific antigen antibody to the reagent and removing unbound serum components by washing, the reagent is reacted with reporter-labeled anti-human antibody to bind reporter to the reagent in proportion to the amount of bound anti-antigen antibody on the solid support. The reagent is again washed to remove unbound labeled antibody, and the amount of reporter associated with the reagent is determined. Typically, the reporter is an enzyme which is detected by incubating the solid phase in the presence of a suitable fluorometric, luminescent or colorimetric substrate (Sigma, St. Louis, Mo.).

The solid surface reagent in the above assay is prepared by known techniques for attaching protein material to solid support material, such as polymeric beads, dip sticks, 96-well plate or filter material. These attachment methods generally include non-specific adsorption of the protein to the support or covalent attachment of the protein, typically through a free amine group, to a chemically reactive group on the solid support, such as an activated carboxyl, hydroxyl, or aldehyde group. Alternatively, streptavidin coated plates can be used in conjunction with biotinylated antigen(s).

Thus, the invention provides an assay system or kit for carrying out this diagnostic method. The kit generally includes a support with surface-bound recombinant antigens, and a reporter-labeled anti-human antibody for detecting surface-bound anti-antigen antibody.

Fusion Proteins

Any polypeptide of the present invention can be used to generate fusion proteins. For example, the polypeptide of the present invention, when fused to a second protein, can be used as an antigenic tag. Antibodies raised against the polypeptide of the present invention can be used to indirectly detect the second protein by binding to the polypeptide. Moreover, because secreted proteins target cellular locations based on trafficking signals, the polypeptides of the present invention can be used as targeting molecules once fused to other proteins.

Examples of domains that can be fused to polypeptides of the present invention include not only heterologous signal sequences, but also other heterologous functional regions. The fusion does not necessarily need to be direct, but may occur through linker sequences.

Moreover, fusion proteins may also be engineered to improve characteristics of the polypeptide of the present invention. For instance, a region of additional amino acids, particularly charged amino acids, may be added to the N-terminus of the polypeptide to improve stability and persistence during purification from the host cell or subsequent handling and storage. Also, peptide moieties may be added to the polypeptide to facilitate purification. Such regions may be removed prior to final preparation of the polypeptide. The addition of peptide moieties to facilitate handling of polypeptides are familiar and routine techniques in the art.

Moreover, polypeptides of the present invention, including fragments, and specifically epitopes, can be combined with parts of the constant domain of immunoglobulins (IgA, IgE, IgG, IgM) or portions thereof (CHL CH2, CH3, and any combination thereof, including both entire domains and portions thereof), resulting in chimeric polypeptides. These fusion proteins facilitate purification and show an increased half-life in vivo. One reported example describes chimeric proteins consisting of the first two domains of the human CD4-polypeptide and various domains of the constant regions of the heavy or light chains of mammalian immunoglobulins. (EP A 394,827; Traunecker et al., Nature 331:84-86 (1988).) Fusion proteins having disulfide-linked dimeric structures (due to the IgG) can also be more efficient in binding and neutralizing other molecules, than the monomeric secreted protein or protein fragment alone. (Fountoulakis et al., J. Biochem. 270:3958-3964 (1995).) Polynucleotides comprising or alternatively consisting of nucleic acids which encode these fusion proteins are also encompassed by the invention.

Similarly, EP-A-0 464 533 (Canadian counterpart 2045869) discloses fusion proteins comprising various portions of constant region of immunoglobulin molecules together with another human protein or part thereof. In many cases, the Fc part in a fusion protein is beneficial in therapy and diagnosis, and thus can result in, for example, improved pharmacokinetic properties. (EP-A 0232 262.) Alternatively, deleting the Fc part after the fusion protein has been expressed, detected, and purified, would be desired. For example, the Fc portion may hinder therapy and diagnosis if the fusion protein is used as an antigen for immunizations. In drug discovery, for example, human proteins, such as hIL-5, have been fused with Fc portions for the purpose of high-throughput screening assays to identify antagonists of hIL-5. (See, D. Bennett et al., J. Molecular Recognition 8:52-58 (1995); K. Johanson et al., J. Biol. Chem. 270:9459-9471 (1995).)

Moreover, the polypeptides of the present invention can be fused to marker sequences, such as a peptide which facilitates purification of the fused polypeptide. In preferred embodiments, the marker amino acid sequence is a hexa-histidine peptide, such as the tag provided in a pQE vector (QIAGEN, Inc., 9259 Eton Avenue, Chatsworth, Calif., 91311), among others, many of which are commercially available. As described in Gentz et al., Proc. Natl. Acad. Sci. USA 86:821-824 (1989), for instance, hexa-histidine provides for convenient purification of the fusion protein. Another peptide tag useful for purification, the "HA" tag, corresponds to an epitope derived from the influenza hemagglutinin protein. (Wilson et al., Cell 37:767 (1984).)

Thus, any of these above fusions can be engineered using the polynucleotides or the polypeptides of the present invention.

Vectors, Host Cells, and Protein Production

The present invention also relates to vectors containing the polynucleotide of the present invention, host cells, and the production of polypeptides by recombinant techniques. The vector may be, for example, a phage, plasmid, viral, or retroviral vector. Retroviral vectors may be replication competent or replication defective. In the latter case, viral propagation generally will occur only in complementing host cells.

The polynucleotides may be joined to a vector containing a selectable marker for propagation in a host. Generally, a plasmid vector is introduced in a precipitate, such as a calcium phosphate precipitate, or in a complex with a charged lipid. If the vector is a virus, it may be packaged in vitro using an appropriate packaging cell line and then transduced into host cells.

The polynucleotide insert should be operatively linked to an appropriate promoter, such as the phage lambda PL promoter, the E. coli lac, trp, phoA and tac promoters, the SV40 early and late promoters and promoters of retroviral LTRs, to name a few. Other suitable promoters will be known to the skilled artisan. The expression constructs will further contain sites for transcription initiation, termination, and, in the transcribed region, a ribosome binding site for translation. The coding portion of the transcripts expressed by the constructs will preferably include a translation initiating codon at the beginning and a termination codon (UAA, UGA or UAG) appropriately positioned at the end of the polypeptide to be translated.

As indicated, the expression vectors will preferably include at least one selectable marker. Such markers include dihydrofolate reductase, G418 or neomycin resistance for eukaryotic cell culture and tetracycline, kanamycin or ampicillin resistance genes for culturing in E. coli and other bacteria. Representative examples of appropriate hosts include, but are not limited to, bacterial cells, such as E. coli, Streptomyces and Salmonella typhimurium cells; fungal cells, such as yeast cells (e.g., Saccharomyces cerevisiae or Pichia pastoris (ATCC Accession No. 201178)); insect cells such as Drosophila S2 and Spodoptera S19 cells; animal cells such as CHO, COS, 293, and Bowes melanoma cells; and plant cells. Appropriate culture mediums and conditions for the above-described host cells are known in the art.

Among vectors preferred for use in bacteria include pQE70, pQE60 and pQE-9, available from QIAGEN, Inc.; pBluescript vectors, Phagescript vectors, pNH8A, pNH16a, pNH18A, pNH46A, available from Stratagene Cloning Systems, Inc.; and ptrc99a, pKK223-3, pKK233-3, pDR540, pRIT5 available from Pharmacia Biotech, Inc. Among preferred eukaryotic vectors are pWLNEO, pSV2CAT, pOG44, pXT1 and pSG available from Stratagene; and pSVK3, pBPV, pMSG and pSVL available from Pharmacia. Preferred expression vectors for use in yeast systems include, but are not limited to pYES2, pYD1, pTEF1/Zeo, pYES2/GS, pPIC-Z,pGAPZ, pGAPZalph, pPIC9, pPIC3.5, pHIL-D2, pHIL-S1, pPIC3.5K, pPIC9K, and PAO815 (all available from Invitrogen, Carlbad, Calif.). Other suitable vectors will be readily apparent to the skilled artisan.

Introduction of the construct into the host cell can be effected by calcium phosphate transfection, DEAE-dextran mediated transfection, cationic lipid-mediated transfection, electroporation, transduction, infection, or other methods. Such methods are described in many standard laboratory manuals, such as Davis et al., Basic Methods In Molecular Biology (1986). It is specifically contemplated that the polypeptides of the present invention may in fact be expressed by a host cell lacking a recombinant vector.

A polypeptide of this invention can be recovered and purified from recombinant cell cultures by well-known methods including ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. Most preferably, high performance liquid chromatography ("HPLC") is employed for purification.

Polypeptides of the present invention, and preferably the secreted form, can also be recovered from: products purified from natural sources, including bodily fluids, tissues and cells, whether directly isolated or cultured; products of chemical synthetic procedures; and products produced by recombinant techniques from a prokaryotic or eukaryotic host, including, for example, bacterial, yeast, higher plant, insect, and mammalian cells. Depending upon the host employed in a recombinant production procedure, the polypeptides of the present invention may be glycosylated or may be non-glycosylated. In addition, polypeptides of the invention may also include an initial modified methionine residue, in some cases as a result of host-mediated processes. Thus, it is well known in the art that the N-terminal methionine encoded by the translation initiation codon generally is removed with high efficiency from any protein after translation in all eukaryotic cells. While the N-terminal methionine on most proteins also is efficiently removed in most prokaryotes, for some proteins, this prokaryotic removal process is inefficient, depending on the nature of the amino acid to which the N-terminal methionine is covalently linked.

In one embodiment, the yeast Pichia pastoris is used to express the polypeptide of the present invention in a eukaryotic system. Pichia pastoris is a methylotrophic yeast which can metabolize methanol as its sole carbon source. A main step in the methanol metabolization pathway is the oxidation of methanol to formaldehyde using $O_2$. This reaction is catalyzed by the enzyme alcohol oxidase. In order to metabolize methanol as its sole carbon source, Pichia pastoris must generate high levels of alcohol oxidase due, in part, to the relatively low affinity of alcohol oxidase for $O_2$. Consequently, in a growth medium depending on methanol as a main carbon source, the promoter region of one of the two alcohol oxidase genes (AOX1) is highly active. In the presence of methanol, alcohol oxidase produced from the AOX1 gene comprises up to approximately 30% of the total soluble protein in Pichia pastoris. See, Ellis, S. B., et al., Mol. Cell. Biol. 5:1111-21 (1985); Koutz, P. J, et al., Yeast 5:167-77 (1989); Tschopp, J. F., et al., Nucl. Acids Res. 15:3859-76 (1987). Thus, a heterologous coding sequence, such as, for example, a polynucleotide of the present invention, under the transcriptional regulation of all or part of the AOX1 regulatory sequence is expressed at exceptionally high levels in Pichia yeast grown in the presence of methanol.

In one example, the plasmid vector pPIC9K is used to express DNA encoding a polypeptide of the invention, as set forth herein, in a Pichea yeast system essentially as described in "Pichia Protocols: Methods in Molecular Biology," D. R. Higgins and J. Cregg, eds. The Humana Press, Totowa, N.J., 1998. This expression vector allows expression and secretion of a protein of the invention by virtue of the strong AOX1 promoter linked to the Pichia pastoris alkaline phosphatase (PHO) secretory signal peptide (i.e., leader) located upstream of a multiple cloning site.

Many other yeast vectors could be used in place of pPIC9K, such as, pYES2, pYD1, pTEF1/Zeo, pYES2/GS, pPICZ, pGAPZ, pGAPZalpha, pPIC9, pPIC3.5, pHIL-D2, pHIL-S1, pPIC3.5K, and PA0815, as one skilled in the art would readily appreciate, as long as the proposed expression construct provides appropriately located signals for transcription, translation, secretion (if desired), and the like, including an in-frame AUG as required.

In another embodiment, high-level expression of a heterologous coding sequence, such as, for example, a polynucleotide of the present invention, may be achieved by cloning the heterologous polynucleotide of the invention into an expression vector such as, for example, pGAPZ or pGAPZalpha, and growing the yeast culture in the absence of methanol.

In addition to encompassing host cells containing the vector constructs discussed herein, the invention also encompasses primary, secondary, and immortalized host cells of vertebrate origin, particularly mammalian origin, that have been engineered to delete or replace endogenous genetic material (e.g., coding sequence), and/or to include genetic material (e.g., heterologous polynucleotide sequences) that is operably associated with the polynucleotides of the invention, and which activates, alters, and/or amplifies endogenous polynucleotides. For example, techniques known in the art may be used to operably associate heterologous control regions (e.g., promoter and/or enhancer) and endogenous polynucleotide sequences via homologous recombination, resulting in the formation of a new transcription unit (see, e.g., U.S. Pat. No. 5,641,670, issued Jun. 24, 1997; U.S. Pat. No. 5,733,761, issued Mar. 31, 1998; International Publication No. WO 96/29411, published Sep. 26, 1996; International Publication No. WO 94/12650, published Aug. 4, 1994; Koller et al., Proc. Natl. Acad. Sci. USA 86:8932-8935 (1989); and Zijlstra et al., Nature 342:435-438 (1989), the disclosures of each of which are incorporated by reference in their entireties).

In addition, polypeptides of the invention can be chemically synthesized using techniques known in the art (e.g., see Creighton, 1983, Proteins: Structures and Molecular Principles, W.H. Freeman & Co., N.Y., and Hunkapiller et al., Nature, 310:105-111 (1984)). For example, a polypeptide corresponding to a fragment of a polypeptide sequence of the invention can be synthesized by use of a peptide synthesizer. Furthermore, if desired, nonclassical amino acids or chemical amino acid analogs can be introduced as a substitution or addition into the polypeptide sequence. Non-classical amino acids include, but are not limited to, to the D-isomers of the common amino acids, 2,4-diaminobutyric acid, a-amino isobutyric acid, 4-aminobutyric acid, Abu, 2-amino butyric acid, g-Abu, e-Ahx, 6-amino hexanoic acid, Aib, 2-amino isobutyric acid, 3-amino propionic acid, ornithine, norleucine, norvaline, hydroxyproline, sarcosine, citrulline, homocitrulline, cysteic acid, t-butylglycine, t-butylalanine, phenylglycine, cyclohexylalanine, b-alanine, fluoro-amino acids, designer amino acids such as b-methyl amino acids, Ca-methyl amino acids, Na-methyl amino acids, and amino acid analogs in general. Furthermore, the amino acid can be D (dextrorotary) or L (levorotary).

The invention encompasses polypeptides which are differentially modified during or after translation, e.g., by glycosylation, acetylation, phosphorylation, amidation, derivatization by known protecting/blocking groups, proteolytic cleavage, linkage to an antibody molecule or other cellular ligand, etc. Any of numerous chemical modifications may be carried out by known techniques, including but not limited, to specific chemical cleavage by cyanogen bromide, trypsin, chymotrypsin, papain, V8 protease, $NaBH_4$; acetylation, formylation, oxidation, reduction; metabolic synthesis in the presence of tunicamycin; etc.

Additional post-translational modifications encompassed by the invention include, for example, e.g., N-linked or O-linked carbohydrate chains, processing of N-terminal or C-terminal ends), attachment of chemical moieties to the amino acid backbone, chemical modifications of N-linked or O-linked carbohydrate chains, and addition or deletion of an N-terminal methionine residue as a result of procaryotic host cell expression. The polypeptides may also be modified with a detectable label, such as an enzymatic, fluorescent, isotopic or affinity label to allow for detection and isolation of the protein.

Also provided by the invention are chemically modified derivatives of the polypeptides of the invention which may provide additional advantages such as increased solubility, stability and circulating time of the polypeptide, or decreased immunogenicity (see U.S. Pat. No. 4,179,337). The chemical moieties for derivitization may be selected from water soluble polymers such as polyethylene glycol, ethylene glycol/propylene glycol copolymers, carboxymethylcellulose, dextran, polyvinyl alcohol and the like. The polypeptides may be modified at random positions within the molecule, or at predetermined positions within the molecule and may include one, two, three or more attached chemical moieties.

The polymer may be of any molecular weight, and may be branched or unbranched. For polyethylene glycol, the preferred molecular weight is between about 1 kDa and about 100 kDa (the term "about" indicating that in preparations of polyethylene glycol, some molecules will weigh more, some less, than the stated molecular weight) for ease in handling and manufacturing. Other sizes may be used, depending on the desired therapeutic profile (e.g., the duration of sustained release desired, the effects, if any on biological activity, the ease in handling, the degree or lack of antigenicity and other known effects of the polyethylene glycol to a therapeutic protein or analog). For example, the polyethylene glycol may have an average molecular weight of about 200, 500, 1000, 1500, 2000, 2500, 3000, 3500, 4000, 4500, 5000, 5500, 6000, 6500, 7000, 7500, 8000, 8500, 9000, 9500, 10,000, 10,500, 11,000, 11,500, 12,000, 12,500, 13,000, 13,500, 14,000, 14,500, 15,000, 15,500, 16,000, 16,500, 17,000, 17,500, 18,000, 18,500, 19,000, 19,500, 20,000, 25,000, 30,000, 35,000, 40,000, 50,000, 55,000, 60,000, 65,000, 70,000, 75,000, 80,000, 85,000, 90,000, 95,000, or 100,000 kDa.

As noted above, the polyethylene glycol may have a branched structure. Branched polyethylene glycols are described, for example, in U.S. Pat. No. 5,643,575; Morpurgo et al., *Appl. Biochem. Biotechnol.* 56:59-72 (1996); Vorobjev et al., *Nucleosides Nucleotides* 18:2745-2750 (1999); and Caliceti et al., *Bioconjug. Chem.* 10:638-646 (1999), the disclosures of each of which are incorporated herein by reference.

The polyethylene glycol molecules (or other chemical moieties) should be attached to the protein with consideration of effects on functional or antigenic domains of the protein. There are a number of attachment methods available to those skilled in the art, e.g., EP 0 401 384, herein incorporated by reference (coupling PEG to G-CSF), see also Malik et al., *Exp. Hematol.* 20:1028-1035 (1992) (reporting pegylation of GM-CSF using tresyl chloride). For example, polyethylene glycol may be covalently bound through amino acid residues via a reactive group, such as, a free amino or carboxyl group. Reactive groups are those to which an activated polyethylene glycol molecule may be bound. The amino acid residues having a free amino group may include lysine residues and the N-terminal amino acid residues; those having a free carboxyl group may include aspartic acid residues glutamic acid residues and the C-terminal amino acid residue. Sulfhydryl groups may also be used as a reactive group for attaching the polyethylene glycol molecules. Preferred for therapeutic purposes is attachment at an amino group, such as attachment at the N-terminus or lysine group.

As suggested above, polyethylene glycol may be attached to proteins via linkage to any of a number of amino acid residues. For example, polyethylene glycol can be linked to a proteins via covalent bonds to lysine, histidine, aspartic acid, glutamic acid, or cysteine residues. One or more reaction chemistries may be employed to attach polyethylene glycol to specific amino acid residues (e.g., lysine, histidine, aspartic acid, glutamic acid, or cysteine) of the protein or to more than one type of amino acid residue (e.g., lysine, histidine, aspartic acid, glutamic acid, cysteine and combinations thereof) of the protein.

One may specifically desire proteins chemically modified at the N-terminus. Using polyethylene glycol as an illustration of the present composition, one may select from a variety of polyethylene glycol molecules (by molecular weight, branching, etc.), the proportion of polyethylene glycol molecules to protein (polypeptide) molecules in the reaction mix, the type of pegylation reaction to be performed, and the method of obtaining the selected N-terminally pegylated protein. The method of obtaining the N-terminally pegylated preparation (i.e., separating this moiety from other monopegylated moieties if necessary) may be by purification of the N-terminally pegylated material from a population of pegylated protein molecules. Selective proteins chemically modified at the N-terminus modification may be accomplished by reductive alkylation which exploits differential reactivity of different types of primary amino groups (lysine versus the N-terminal) available for derivatization in a particular protein. Under the appropriate reaction conditions, substantially selective derivatization of the protein at the N-terminus with a carbonyl group containing polymer is achieved.

As indicated above, pegylation of the proteins of the invention may be accomplished by any number of means. For example, polyethylene glycol may be attached to the protein either directly or by an intervening linker. Linkerless systems for attaching polyethylene glycol to proteins are described in Delgado et al., *Crit. Rev. Thera. Drug Carrier Sys.* 9:249-304 (1992); Francis et al., *Intern. J. of Hematol.* 68:1-18 (1998); U.S. Pat. No. 4,002,531; U.S. Pat. No. 5,349,052; WO 95/06058; and WO 98/32466, the disclosures of each of which are incorporated herein by reference.

One system for attaching polyethylene glycol directly to amino acid residues of proteins without an intervening linker employs tresylated MPEG, which is produced by the modification of monmethoxy polyethylene glycol (MPEG) using tresylchloride ($ClSO_2CH_2CF_3$). Upon reaction of protein with tresylated MPEG, polyethylene glycol is directly attached to amine groups of the protein. Thus, the invention includes protein-polyethylene glycol conjugates produced by reacting proteins of the invention with a polyethylene glycol molecule having a 2,2,2-trifluoreothane sulphonyl group.

Polyethylene glycol can also be attached to proteins using a number of different intervening linkers. For example, U.S. Pat. No. 5,612,460, the entire disclosure of which is incorporated herein by reference, discloses urethane linkers for connecting polyethylene glycol to proteins. Protein-polyethylene glycol conjugates wherein the polyethylene glycol is attached to the protein by a linker can also be produced by reaction of proteins with compounds such as MPEG-succinimidylsuccinate, MPEG activated with 1,1'-carbonyldiimidazole, MPEG-2,4,5-trichloropenylcarbonate, MPEG-p-nitrophenolcarbonate, and various MPEG-succinate derivatives. A number additional polyethylene glycol derivatives and reaction chemistries for attaching polyethylene glycol to proteins are described in WO 98/32466, the entire disclosure of which is incorporated herein by reference. Pegylated protein products produced using the reaction chemistries set out herein are included within the scope of the invention.

The number of polyethylene glycol moieties attached to each protein of the invention (i.e., the degree of substitution) may also vary. For example, the pegylated proteins of the invention may be linked, on average, to 1, 2, 3, 4, 5, 6, 7, 8, 9, 10, 12, 15, 17, 20, or more polyethylene glycol molecules. Similarly, the average degree of substitution within ranges such as 1-3, 2-4, 3-5, 4-6, 5-7, 6-8, 7-9, 8-10, 9-11, 10-12, 11-13, 12-14, 13-15, 14-16, 15-17, 16-18, 17-19, or 18-20 polyethylene glycol moieties per protein molecule. Methods for determining the degree of substitution are discussed, for example, in Delgado et al., Crit. Rev. Thera. Drug Carrier Sys. 9:249-304 (1992).

The polypeptides of the invention may be in monomers or multimers (i.e., dimers, trimers, tetramers and higher multimers). Accordingly, the present invention relates to monomers and multimers of the polypeptides of the invention, their preparation, and compositions (preferably, Therapeutics) containing them. In specific embodiments, the polypeptides of the invention are monomers, dimers, trimers or tetramers. In additional embodiments, the multimers of the invention are at least dimers, at least trimers, or at least tetramers.

Multimers encompassed by the invention may be homomers or heteromers. As used herein, the term homomer, refers to a multimer containing only polypeptides corresponding to the amino acid sequence of SEQ ID NO:Y or encoded by the cDNA contained in a deposited clone (including fragments, variants, splice variants, and fusion proteins, corresponding to these polypeptides as described herein). These homomers may contain polypeptides having identical or different amino acid sequences. In a specific embodiment, a homomer of the invention is a multimer containing only polypeptides having an identical amino acid sequence. In another specific embodiment, a homomer of the invention is a multimer containing polypeptides having different amino acid sequences. In specific embodiments, the multimer of the invention is a homodimer (e.g., containing polypeptides having identical or different amino acid sequences) or a homotrimer (e.g., containing polypeptides having identical and/or different amino acid sequences). In additional embodiments, the homomeric multimer of the invention is at least a homodimer, at least a homotrimer, or at least a homotetramer.

As used herein, the term heteromer refers to a multimer containing one or more heterologous polypeptides (i.e., polypeptides of different proteins) in addition to the polypeptides of the invention. In a specific embodiment, the multimer of the invention is a heterodimer, a heterotrimer, or a heterotetramer. In additional embodiments, the heteromeric multimer of the invention is at least a heterodimer, at least a heterotrimer, or at least a heterotetramer.

Multimers of the invention may be the result of hydrophobic, hydrophilic, ionic and/or covalent associations and/or may be indirectly linked, by for example, liposome formation. Thus, in one embodiment, multimers of the invention, such as, for example, homodimers or homotrimers, are formed when polypeptides of the invention contact one another in solution. In another embodiment, heteromultimers of the invention, such as, for example, heterotrimers or heterotetramers, are formed when polypeptides of the invention contact antibodies to the polypeptides of the invention (including antibodies to the heterologous polypeptide sequence in a fusion protein of the invention) in solution. In other embodiments, multimers of the invention are formed by covalent associations with and/or between the polypeptides of the invention. Such covalent associations may involve one or more amino acid residues contained in the polypeptide sequence (e.g., that recited in the sequence listing, or contained in the polypeptide encoded by a deposited clone). In one instance, the covalent associations are cross-linking between cysteine residues located within the polypeptide sequences which interact in the native (i.e., naturally occurring) polypeptide. In another instance, the covalent associations are the consequence of chemical or recombinant manipulation. Alternatively, such covalent associations may involve one or more amino acid residues contained in the heterologous polypeptide sequence in a fusion protein of the invention.

In one example, covalent associations are between the heterologous sequence contained in a fusion protein of the invention (see, e.g., U.S. Pat. No. 5,478,925). In a specific example, the covalent associations are between the heterologous sequence contained in an Fc fusion protein of the invention (as described herein). In another specific example, covalent associations of fusion proteins of the invention are between heterologous polypeptide sequence from another protein that is capable of forming covalently associated multimers, such as for example, oseteoprotegerin (see, e.g., International Publication NO: WO 98/49305, the contents of which are herein incorporated by reference in its entirety). In another embodiment, two or more polypeptides of the invention are joined through peptide linkers. Examples include those peptide linkers described in U.S. Pat. No. 5,073,627 (hereby incorporated by reference). Proteins comprising multiple polypeptides of the invention separated by peptide linkers may be produced using conventional recombinant DNA technology.

Another method for preparing multimer polypeptides of the invention involves use of polypeptides of the invention fused to a leucine zipper or isoleucine zipper polypeptide sequence. Leucine zipper and isoleucine zipper domains are polypeptides that promote multimerization of the proteins in which they are found. Leucine zippers were originally identified in several DNA-binding proteins (Landschulz et al., Science 240:1759, (1988)), and have since been found in a variety of different proteins. Among the known leucine zippers are naturally occurring peptides and derivatives thereof that dimerize or trimerize. Examples of leucine zipper domains suitable for producing soluble multimeric proteins of the invention are those described in PCT application WO 94/10308, hereby incorporated by reference. Recombinant fusion proteins comprising a polypeptide of the invention fused to a polypeptide sequence that dimerizes or trimerizes in solution are expressed in suitable host cells, and the resulting soluble multimeric fusion protein is recovered from the culture supernatant using techniques known in the art.

Trimeric polypeptides of the invention may offer the advantage of enhanced biological activity. Preferred leucine zipper moieties and isoleucine moieties are those that preferentially form trimers. One example is a leucine zipper derived from lung surfactant protein D (SPD), as described in Hoppe et al. (FEBS Letters 344:191, (1994)) and in U.S. patent application Ser. No. 08/446,922, hereby incorporated by reference. Other peptides derived from naturally occurring trimeric proteins may be employed in preparing trimeric polypeptides of the invention.

In another example, proteins of the invention are associated by interactions between Flag® polypeptide sequence contained in fusion proteins of the invention containing Flag® polypeptide seugence. In a further embodiment, associations proteins of the invention are associated by interactions between heterologous polypeptide sequence contained in Flag® fusion proteins of the invention and anti-Flag® antibody.

The multimers of the invention may be generated using chemical techniques known in the art. For example, polypeptides desired to be contained in the multimers of the invention may be chemically cross-linked using linker molecules and linker molecule length optimization techniques known in the art (see, e.g., U.S. Pat. No. 5,478,925, which is herein incorporated by reference in its entirety). Additionally, multimers of the invention may be generated using techniques known in the art to form one or more inter-molecule cross-links between the cysteine residues located within the sequence of the polypeptides desired to be contained in the multimer (see, e.g., U.S. Pat. No. 5,478,925, which is herein incorporated by reference in its entirety). Further, polypeptides of the invention may be routinely modified by the addition of cysteine or biotin to the C terminus or N-terminus of the polypeptide and techniques known in the art may be applied to generate multimers containing one or more of these modified polypeptides (see, e.g., U.S. Pat. No. 5,478,925, which is herein incorporated by reference in its entirety). Additionally, techniques known in the art may be applied to generate liposomes containing the polypeptide components desired to be contained in the multimer of the invention (see, e.g., U.S. Pat. No. 5,478,925, which is herein incorporated by reference in its entirety).

Alternatively, multimers of the invention may be generated using genetic engineering techniques known in the art. In one embodiment, polypeptides contained in multimers of the invention are produced recombinantly using fusion protein technology described herein or otherwise known in the art (see, e.g., U.S. Pat. No. 5,478,925, which is herein incorporated by reference in its entirety). In a specific embodiment, polynucleotides coding for a homodimer of the invention are generated by ligating a polynucleotide sequence encoding a polypeptide of the invention to a sequence encoding a linker polypeptide and then further to a synthetic polynucleotide encoding the translated product of the polypeptide in the reverse orientation from the original C-terminus to the N-terminus (lacking the leader sequence) (see, e.g., U.S. Pat. No. 5,478,925, which is herein incorporated by reference in its entirety). In another embodiment, recombinant techniques described herein or otherwise known in the art are applied to generate recombinant polypeptides of the invention which contain a transmembrane domain (or hyrophobic or signal peptide) and which can be incorporated by membrane reconstitution techniques into liposomes (see, e.g., U.S. Pat. No. 5,478,925, which is herein incorporated by reference in its entirety).

Uses of the Polynucleotides

Each of the polynucleotides identified herein can be used in numerous ways as reagents. The following description should be considered exemplary and utilizes known techniques.

The polynucleotides of the present invention are useful for chromosome identification. There exists an ongoing need to identify new chromosome markers, since few chromosome marking reagents, based on actual sequence data (repeat polymorphisms), are presently available. Each polynucleotide of the present invention can be used as a chromosome marker.

Briefly, sequences can be mapped to chromosomes by preparing PCR primers (preferably 15-25 bp) from the sequences shown in SEQ ID NO:X. Primers can be selected using computer analysis so that primers do not span more than one predicted exon in the genomic DNA. These primers are then used for PCR screening of somatic cell hybrids containing individual human chromosomes. Only those hybrids containing the human gene corresponding to the SEQ ID NO:X will yield an amplified fragment.

Similarly, somatic hybrids provide a rapid method of PCR mapping the polynucleotides to particular chromosomes. Three or more clones can be assigned per day using a single thermal cycler. Moreover, sublocalization of the polynucleotides can be achieved with panels of specific chromosome fragments. Other gene mapping strategies that can be used include in situ hybridization, prescreening with labeled flow-sorted chromosomes, preselection by hybridization to construct chromosome specific-cDNA libraries and computer mapping techniques (See, e.g., Shuler, Trends Biotechnol 16:456-459 (1998) which is hereby incorporated by reference in its entirety).

Precise chromosomal location of the polynucleotides can also be achieved using fluorescence in situ hybridization (FISH) of a metaphase chromosomal spread. This technique uses polynucleotides as short as 500 or 600 bases; however, polynucleotides 2,000-4,000 by are preferred. For a review of this technique, see Verma et al., "Human Chromosomes: a Manual of Basic Techniques," Pergamon Press, New York (1988).

For chromosome mapping, the polynucleotides can be used individually (to mark a single chromosome or a single site on that chromosome) or in panels (for marking multiple sites and/or multiple chromosomes).

The polynucleotides of the present invention would likewise be useful for radiation hybrid mapping, HAPPY mapping, and long range restriction mapping. For a review of these techniques and others known in the art, see, e.g., Dear, "Genome Mapping: A Practical Approach," IRL Press at Oxford University Press, London (1997); Aydin, J. Mol. Med. 77:691-694 (1999); Hacia et al., Mol. Psychiatry. 3:483-492 (1998); Herrick et al., Chromosome Res. 7:409-423 (1999); Hamilton et al., Methods Cell Biol. 62:265-280 (2000); and/or Ott, J. Hered. 90:68-70 (1999) each of which is hereby incorporated by reference in its entirety.

Once a polynucleotide has been mapped to a precise chromosomal location, the physical position of the polynucleotide can be used in linkage analysis. Linkage analysis establishes coinheritance between a chromosomal location and presentation of a particular disease. (Disease mapping data are found, for example, in V. McKusick, Mendelian Inheritance in Man (available on line through Johns Hopkins University Welch Medical Library).) Assuming 1 megabase mapping resolution and one gene per 20 kb, a cDNA precisely localized to a chromosomal region associated with the disease could be one of 50-500 potential causative genes.

Thus, once coinheritance is established, differences in the polynucleotide and the corresponding gene between affected and unaffected individuals can be examined. First, visible structural alterations in the chromosomes, such as deletions or translocations, are examined in chromosome spreads or by PCR. If no structural alterations exist, the presence of point mutations are ascertained. Mutations observed in some or all affected individuals, but not in normal individuals, indicates that the mutation may cause the disease. However, complete sequencing of the polypeptide and the corresponding gene from several normal individuals is required to distinguish the mutation from a polymorphism. If a new polymorphism is identified, this polymorphic polypeptide can be used for further linkage analysis.

Furthermore, increased or decreased expression of the gene in affected individuals as compared to unaffected individuals can be assessed using polynucleotides of the present invention. Any of these alterations (altered expression, chromosomal rearrangement, or mutation) can be used as a diagnostic or prognostic marker.

Thus, the invention also provides a diagnostic method useful during diagnosis of a disorder, involving measuring the expression level of polynucleotides of the present invention in cells or body fluid from an individual and comparing the measured gene expression level with a standard level of polynucleotide expression level, whereby an increase or decrease in the gene expression level compared to the standard is indicative of a disorder.

In still another embodiment, the invention includes a kit for analyzing samples for the presence of proliferative and/or cancerous polynucleotides derived from a test subject. In a general embodiment, the kit includes at least one polynucleotide probe containing a nucleotide sequence that will specifically hybridize with a polynucleotide of the present invention and a suitable container. In a specific embodiment, the kit includes two polynucleotide probes defining an internal region of the polynucleotide of the present invention, where each probe has one strand containing a 31' mer-end internal to the region. In a further embodiment, the probes may be useful as primers for polymerase chain reaction amplification.

Where a diagnosis of a disorder, has already been made according to conventional methods, the present invention is useful as a prognostic indicator, whereby patients exhibiting enhanced or depressed polynucleotide of the present invention expression will experience a worse clinical outcome relative to patients expressing the gene at a level nearer the standard level.

By "measuring the expression level of polynucleotide of the present invention" is intended qualitatively or quantitatively measuring or estimating the level of the polypeptide of the present invention or the level of the mRNA encoding the polypeptide in a first biological sample either directly (e.g., by determining or estimating absolute protein level or mRNA level) or relatively (e.g., by comparing to the polypeptide level or mRNA level in a second biological sample). Preferably, the polypeptide level or mRNA level in the first biological sample is measured or estimated and compared to a standard polypeptide level or mRNA level, the standard being taken from a second biological sample obtained from an individual not having the disorder or being determined by averaging levels from a population of individuals not having a disorder. As will be appreciated in the art, once a standard polypeptide level or mRNA level is known, it can be used repeatedly as a standard for comparison.

By "biological sample" is intended any biological sample obtained from an individual, body fluid, cell line, tissue culture, or other source which contains the polypeptide of the present invention or mRNA. As indicated, biological samples include body fluids (such as semen, lymph, sera, plasma, urine, synovial fluid and spinal fluid) which contain the polypeptide of the present invention, and other tissue sources found to express the polypeptide of the present invention. Methods for obtaining tissue biopsies and body fluids from mammals are well known in the art. Where the biological sample is to include mRNA, a tissue biopsy is the preferred source.

The method(s) provided above may preferably be applied in a diagnostic method and/or kits in which polynucleotides and/or polypeptides are attached to a solid support. In one exemplary method, the support may be a "gene chip" or a "biological chip" as described in U.S. Pat. Nos. 5,837,832, 5,874,219, and 5,856,174. Further, such a gene chip with polynucleotides of the present invention attached may be used to identify polymorphisms between the polynucleotide sequences, with polynucleotides isolated from a test subject. The knowledge of such polymorphisms (i.e. their location, as well as, their existence) would be beneficial in identifying disease loci for many disorders, including cancerous diseases and conditions. Such a method is described in U.S. Pat. Nos. 5,858,659 and 5,856,104. The US Patents referenced supra are hereby incorporated by reference in their entirety herein.

The present invention encompasses polynucleotides of the present invention that are chemically synthesized, or reproduced as peptide nucleic acids (PNA), or according to other methods known in the art. The use of PNAs would serve as the preferred form if the polynucleotides are incorporated onto a solid support, or gene chip. For the purposes of the present invention, a peptide nucleic acid (PNA) is a polyamide type of DNA analog and the monomeric units for adenine, guanine, thymine and cytosine are available commercially (Perceptive Biosystems). Certain components of DNA, such as phosphorus, phosphorus oxides, or deoxyribose derivatives, are not present in PNAs. As disclosed by P. E. Nielsen, M. Egholm, R. H. Berg and O. Buchardt, Science 254, 1497 (1991); and M. Egholm, O. Buchardt, L.Christensen, C. Behrens, S. M. Freier, D. A. Driver, R. H. Berg, S. K. Kim, B. Norden, and P. E. Nielsen, Nature 365, 666 (1993), PNAs bind specifically and tightly to complementary DNA strands and are not degraded by nucleases. In fact, PNA binds more strongly to DNA than DNA itself does. This is probably because there is no electrostatic repulsion between the two strands, and also the polyamide backbone is more flexible. Because of this, PNA/DNA duplexes bind under a wider range of stringency conditions than DNA/DNA duplexes, making it easier to perform multiplex hybridization. Smaller probes can be used than with DNA due to the strong binding. In addition, it is more likely that single base mismatches can be determined with PNA/DNA hybridization because a single mismatch in a PNA/DNA 15-mer lowers the melting point (T.sub.m) by 8°-20° C., vs. 4°-16° C. for the DNA/DNA 15-mer duplex. Also, the absence of charge groups in PNA means that hybridization can be done at low ionic strengths and reduce possible interference by salt during the analysis.

The present invention is useful for detecting cancer in mammals. In particular the invention is useful during diagnosis of pathological cell proliferative neoplasias which include, but are not limited to: acute myelogenous leukemias including acute monocytic leukemia, acute myeloblastic leukemia, acute promyelocytic leukemia, acute myelomonocytic leukemia, acute erythroleukemia, acute megakaryocytic leukemia, and acute undifferentiated leukemia, etc.; and chronic myelogenous leukemias including chronic myelomonocytic leukemia, chronic granulocytic leukemia, etc. Preferred mammals include monkeys, apes, cats, dogs, cows, pigs, horses, rabbits and humans. Particularly preferred are humans.

Pathological cell proliferative diseases, disorders, and/or conditions are often associated with inappropriate activation of proto-oncogenes. (Gelmann, E. P. et al., "The Etiology of Acute Leukemia: Molecular Genetics and Viral Oncology," in Neoplastic Diseases of the Blood, Vol 1., Wiernik, P. H. et al. eds., 161-182 (1985)). Neoplasias are now believed to result from the qualitative alteration of a normal cellular gene product, or from the quantitative modification of gene expression by insertion into the chromosome of a viral sequence, by chromosomal translocation of a gene to a more actively transcribed region, or by some other mechanism. (Gelmann et al., supra) It is likely that mutated or altered expression of specific genes is involved in the pathogenesis of some leukemias, among other tissues and cell types. (Gelmann et al., supra) Indeed, the human counterparts of the oncogenes involved in some animal neoplasias have been amplified or translocated in some cases of human leukemia and carcinoma. (Gelmann et al., supra)

For example, c-myc expression is highly amplified in the non-lymphocytic leukemia cell line HL-60. When HL-60 cells are chemically induced to stop proliferation, the level of c-myc is found to be down-regulated. (International Publication Number WO 91/15580) However, it has been shown that exposure of HL-60 cells to a DNA construct that is complementary to the 5' end of c-myc or c-myb blocks translation of the corresponding mRNAs which downregulates expression of the c-myc or c-myb proteins and causes arrest of cell proliferation and differentiation of the treated cells. (International Publication Number WO 91/15580; Wickstrom et al., Proc. Natl. Acad. Sci. 85:1028 (1988); Anfossi et al., Proc. Natl. Acad. Sci. 86:3379 (1989)). However, the skilled artisan would appreciate the present invention's usefulness would not be limited to treatment of proliferative diseases, disorders, and/or conditions of hematopoietic cells and tissues, in light of the numerous cells and cell types of varying origins which are known to exhibit proliferative phenotypes.

In addition to the foregoing, a polynucleotide can be used to control gene expression through triple helix formation or antisense DNA or RNA. Antisense techniques are discussed, for example, in Okano, J. Neurochem. 56: 560 (1991); "Oligodeoxynucleotides as Antisense Inhibitors of Gene Expression, CRCPress, Boca Raton, Fla. (1988). Triple helix formation is discussed in, for instance Lee et al., Nucleic Acids Research 6: 3073 (1979); Cooney et al., Science 241: 456 (1988); and Dervan et al., Science 251: 1360 (1991). Both methods rely on binding of the polynucleotide to a complementary DNA or RNA. For these techniques, preferred polynucleotides are usually oligonucleotides 20 to 40 bases in length and complementary to either the region of the gene involved in transcription (triple helix—see Lee et al., Nucl. Acids Res. 6:3073 (1979); Cooney et al., Science 241:456 (1988); and Dervan et al., Science 251:1360 (1991)) or to the mRNA itself (antisense—Okano, J. Neurochem. 56:560 (1991); Oligodeoxy-nucleotides as Antisense Inhibitors of Gene Expression, CRC Press, Boca Raton, Fla. (1988).) Triple helix formation optimally results in a shut-off of RNA transcription from DNA, while antisense RNA hybridization blocks translation of an mRNA molecule into polypeptide. Both techniques are effective in model systems, and the information disclosed herein can be used to design antisense or triple helix polynucleotides in an effort to treat or prevent disease.

Polynucleotides of the present invention are also useful in gene therapy. One goal of gene therapy is to insert a normal gene into an organism having a defective gene, in an effort to correct the genetic defect. The polynucleotides disclosed in the present invention offer a means of targeting such genetic defects in a highly accurate manner. Another goal is to insert a new gene that was not present in the host genome, thereby producing a new trait in the host cell.

The polynucleotides are also useful for identifying individuals from minute biological samples. The United States military, for example, is considering the use of restriction fragment length polymorphism (RFLP) for identification of its personnel. In this technique, an individual's genomic DNA is digested with one or more restriction enzymes, and probed on a Southern blot to yield unique bands for identifying personnel. This method does not suffer from the current limitations of "Dog Tags" which can be lost, switched, or stolen, making positive identification difficult. The polynucleotides of the present invention can be used as additional DNA markers for RFLP.

The polynucleotides of the present invention can also be used as an alternative to RFLP, by determining the actual base-by-base DNA sequence of selected portions of an individual's genome. These sequences can be used to prepare PCR primers for amplifying and isolating such selected DNA, which can then be sequenced. Using this technique, individuals can be identified because each individual will have a unique set of DNA sequences. Once an unique ID database is established for an individual, positive identification of that individual, living or dead, can be made from extremely small tissue samples.

Forensic biology also benefits from using DNA-based identification techniques as disclosed herein. DNA sequences taken from very small biological samples such as tissues, e.g., hair or skin, or body fluids, e.g., blood, saliva, semen, synovial fluid, amniotic fluid, breast milk, lymph, pulmonary sputum or surfactant,urine,fecal matter, etc., can be amplified using PCR. In one prior art technique, gene sequences amplified from polymorphic loci, such as DQa class II HLA gene, are used in forensic biology to identify individuals. (Erlich, H., PCR Technology, Freeman and Co. (1992).) Once these specific polymorphic loci are amplified, they are digested with one or more restriction enzymes, yielding an identifying set of bands on a Southern blot probed with DNA corresponding to the DQa class II HLA gene. Similarly, polynucleotides of the present invention can be used as polymorphic markers for forensic purposes.

There is also a need for reagents capable of identifying the source of a particular tissue. Such need arises, for example, in forensics when presented with tissue of unknown origin. Appropriate reagents can comprise, for example, DNA probes or primers specific to particular tissue prepared from the sequences of the present invention. Panels of such reagents can identify tissue by species and/or by organ type. In a similar fashion, these reagents can be used to screen tissue cultures for contamination.

In the very least, the polynucleotides of the present invention can be used as molecular weight markers on Southern gels, as diagnostic probes for the presence of a specific mRNA in a particular cell type, as a probe to "subtract-out" known sequences in the process of discovering novel polynucleotides, for selecting and making oligomers for attachment to a "gene chip" or other support, to raise anti-DNA antibodies using DNA immunization techniques, and as an antigen to elicit an immune response.

Uses of the Polypeptides

Each of the polypeptides identified herein can be used in numerous ways. The following description should be considered exemplary and utilizes known techniques.

A polypeptide of the present invention can be used to assay protein levels in a biological sample using antibody-based techniques. For example, protein expression in tissues can be studied with classical immunohistological methods. (Jalkanen, M., et al., J. Cell. Biol. 101:976-985 (1985); Jalkanen, M., et al., J. Cell. Biol. 105:3087-3096 (1987).) Other antibody-based methods useful for detecting protein gene expression include immunoassays, such as the enzyme linked immunosorbent assay (ELISA) and the radioimmunoassay (RIA). Suitable antibody assay labels are known in the art and include enzyme labels, such as, glucose oxidase, and radioisotopes, such as iodine ($125I$, $121I$), carbon ($14C$), sulfur ($35S$), tritium ($3H$), indium ($112In$), and technetium ($99mTc$), and fluorescent labels, such as fluorescein and rhodamine, and biotin.

In addition to assaying secreted protein levels in a biological sample, proteins can also be detected in vivo by imaging. Antibody labels or markers for in vivo imaging of protein include those detectable by X-radiography, NMR or ESR. For X-radiography, suitable labels include radioisotopes such as barium or cesium, which emit detectable radiation but are not overtly harmful to the subject. Suitable markers for NMR and ESR include those with a detectable characteristic spin, such as deuterium, which may be incorporated into the antibody by labeling of nutrients for the relevant hybridoma.

A protein-specific antibody or antibody fragment which has been labeled with an appropriate detectable imaging moiety, such as a radioisotope (for example, 131I, 112In, 99mTc), a radio-opaque substance, or a material detectable by nuclear magnetic resonance, is introduced (for example, parenterally, subcutaneously, or intraperitoneally) into the mammal. It will be understood in the art that the size of the subject and the imaging system used will determine the quantity of imaging moiety needed to produce diagnostic images. In the case of a radioisotope moiety, for a human subject, the quantity of radioactivity injected will normally range from about 5 to 20 millicuries of 99mTc. The labeled antibody or antibody fragment will then preferentially accumulate at the location of cells which contain the specific protein. In vivo tumor imaging is described in S. W. Burchiel et al., "Immunopharmacokinetics of Radiolabeled Antibodies and Their Fragments." (Chapter 13 in Tumor Imaging: The Radiochemical Detection of Cancer, S.W. Burchiel and B. A. Rhodes, eds., Masson Publishing Inc. (1982).)

Thus, the invention provides a diagnostic method of a disorder, which involves (a) assaying the expression of a polypeptide of the present invention in cells or body fluid of an individual; (b) comparing the level of gene expression with a standard gene expression level, whereby an increase or decrease in the assayed polypeptide gene expression level compared to the standard expression level is indicative of a disorder. With respect to cancer, the presence of a relatively high amount of transcript in biopsied tissue from an individual may indicate a predisposition for the development of the disease, or may provide a means for detecting the disease prior to the appearance of actual clinical symptoms. A more definitive diagnosis of this type may allow health professionals to employ preventative measures or aggressive treatment earlier thereby preventing the development or further progression of the cancer.

Moreover, polypeptides of the present invention can be used to treat, prevent, and/or diagnose disease. For example, patients can be administered a polypeptide of the present invention in an effort to replace absent or decreased levels of the polypeptide (e.g., insulin), to supplement absent or decreased levels of a different polypeptide (e.g., hemoglobin S for hemoglobin B, SOD, catalase, DNA repair proteins), to inhibit the activity of a polypeptide (e.g., an oncogene or tumor supressor), to activate the activity of a polypeptide (e.g., by binding to a receptor), to reduce the activity of a membrane bound receptor by competing with it for free ligand (e.g., soluble TNF receptors used in reducing inflammation), or to bring about a desired response (e.g., blood vessel growth inhibition, enhancement of the immune response to proliferative cells or tissues).

Similarly, antibodies directed to a polypeptide of the present invention can also be used to treat, prevent, and/or diagnose disease. For example, administration of an antibody directed to a polypeptide of the present invention can bind and reduce overproduction of the polypeptide. Similarly, administration of an antibody can activate the polypeptide, such as by binding to a polypeptide bound to a membrane (receptor).

At the very least, the polypeptides of the present invention can be used as molecular weight markers on SDS-PAGE gels or on molecular sieve gel filtration columns using methods well known to those of skill in the art. Polypeptides can also be used to raise antibodies, which in turn are used to measure protein expression from a recombinant cell, as a way of assessing transformation of the host cell. Moreover, the polypeptides of the present invention can be used to test the following biological activities.

Gene Therapy Methods

Another aspect of the present invention is to gene therapy methods for treatingor preventing disorders, diseases and conditions. The gene therapy methods relate to the introduction of nucleic acid (DNA, RNA and antisense DNA or RNA) sequences into an animal to achieve expression of a polypeptide of the present invention. This method requires a polynucleotide which codes for a polypeptide of the invention that operatively linked to a promoter and any other genetic elements necessary for the expression of the polypeptide by the target tissue. Such gene therapy and delivery techniques are known in the art, see, for example, WO90/11092, which is herein incorporated by reference.

Thus, for example, cells from a patient may be engineered with a polynucleotide (DNA or RNA) comprising a promoter operably linked to a polynucleotide of the invention ex vivo, with the engineered cells then being provided to a patient to be treated with the polypeptide. Such methods are well-known in the art. For example, see Belldegrun et al., J. Natl. Cancer Inst., 85:207-216 (1993); Ferrantini et al., Cancer Research, 53:107-1112 (1993); Ferrantini et al., J. Immunology 153: 4604-4615 (1994); Kaido, T., et al., Int. J. Cancer 60: 221-229 (1995); Ogura et al., Cancer Research 50: 5102-5106 (1990); Santodonato, et al., Human Gene Therapy 7:1-10 (1996); Santodonato, et al., Gene Therapy 4:1246-1255 (1997); and Zhang, et al., Cancer Gene Therapy 3: 31-38 (1996)), which are herein incorporated by reference. In one embodiment, the cells which are engineered are arterial cells. The arterial cells may be reintroduced into the patient through direct injection to the artery, the tissues surrounding the artery, or through catheter injection.

As discussed in more detail below, the polynucleotide constructs can be delivered by any method that delivers injectable materials to the cells of an animal, such as, injection into the interstitial space of tissues (heart, muscle, skin, lung, liver, and the like). The polynucleotide constructs may be delivered in a pharmaceutically acceptable liquid or aqueous carrier.

In one embodiment, the polynucleotide of the invention is delivered as a naked polynucleotide. The term "naked" polynucleotide, DNA or RNA refers to sequences that are free from any delivery vehicle that acts to assist, promote or facilitate entry into the cell, including viral sequences, viral particles, liposome formulations, lipofectin or precipitating agents and the like. However, the polynucleotides of the invention can also be delivered in liposome formulations and lipofectin formulations and the like can be prepared by methods well known to those skilled in the art. Such methods are described, for example, in U.S. Pat. Nos. 5,593,972, 5,589, 466, and 5,580,859, which are herein incorporated by reference.

The polynucleotide vector constructs of the invention used in the gene therapy method are preferably constructs that will not integrate into the host genome nor will they contain sequences that allow for replication. Appropriate vectors include pWLNEO, pSV2CAT, pOG44, pXT1 and pSG available from Stratagene; pSVK3, pBPV, pMSG and pSVL available from Pharmacia; and pEF1/V5, pcDNA3.1, and pRc/CMV2 available from Invitrogen. Other suitable vectors will be readily apparent to the skilled artisan.

Any strong promoter known to those skilled in the art can be used for driving the expression of polynucleotide sequence of the invention. Suitable promoters include adenoviral promoters, such as the adenoviral major late promoter; or heterologous promoters, such as the cytomegalovirus (CMV) promoter; the respiratory syncytial virus (RSV) promoter; inducible promoters, such as the MMT promoter, the metallothionein promoter; heat shock promoters; the albumin promoter; the ApoAI promoter; human globin promoters; viral thymidine kinase promoters, such as the Herpes. Simplex thymidine kinase promoter; retroviral LTRs; the b-actin promoter; and human growth hormone promoters. The promoter also may be the native promoter for the polynucleotides of the invention.

Unlike other gene therapy techniques, one major advantage of introducing naked nucleic acid sequences into target cells is the transitory nature of the polynucleotide synthesis in the cells. Studies have shown that non-replicating DNA sequences can be introduced into cells to provide production of the desired polypeptide for periods of up to six months.

The polynucleotide construct of the invention can be delivered to the interstitial space of tissues within the an animal, including of muscle, skin, brain, lung, liver, spleen, bone marrow, thymus, heart, lymph, blood, bone, cartilage, pancreas, kidney, gall bladder, stomach, intestine, testis, ovary, uterus, rectum, nervous system, eye, gland, and connective tissue. Interstitial space of the tissues comprises the intercellular, fluid, mucopolysaccharide matrix among the reticular fibers of organ tissues, elastic fibers in the walls of vessels or chambers, collagen fibers of fibrous tissues, or that same matrix within connective tissue ensheathing muscle cells or in the lacunae of bone. It is similarly the space occupied by the plasma of the circulation and the lymph fluid of the lymphatic channels. Delivery to the interstitial space of muscle tissue is preferred for the reasons discussed below. They may be conveniently delivered by injection into the tissues comprising these cells. They are preferably delivered to and expressed in persistent, non-dividing cells which are differentiated, although delivery and expression may be achieved in non-differentiated or less completely differentiated cells, such as, for example, stem cells of blood or skin fibroblasts. In vivo muscle cells are particularly competent in their ability to take up and express polynucleotides.

For the nakednucleic acid sequence injection, an effective dosage amount of DNA or RNA will be in the range of from about 0.05 mg/kg body weight to about 50 mg/kg body weight. Preferably the dosage will be from about 0.005 mg/kg to about 20 mg/kg and more preferably from about 0.05 mg/kg to about 5 mg/kg. Of course, as the artisan of ordinary skill will appreciate, this dosage will vary according to the tissue site of injection. The appropriate and effective dosage of nucleic acid sequence can readily be determined by those of ordinary skill in the art and may depend on the condition being treated and the route of administration.

The preferred route of administration is by the parenteral route of injection into the interstitial space of tissues. However, other parenteral routes may also be used, such as, inhalation of an aerosol formulation particularly for delivery to lungs or bronchial tissues, throat or mucous membranes of the nose. In addition, naked DNA constructs can be delivered to arteries during angioplasty by the catheter used in the procedure.

The naked polynucleotides are delivered by any method known in the art, including, but not limited to, direct needle injection at the delivery site, intravenous injection, topical administration, catheter infusion, and so-called "gene guns". These delivery methods are known in the art.

The constructs may also be delivered with delivery vehicles such as viral sequences, viral particles, liposome formulations, lipofectin, precipitating agents, etc. Such methods of delivery are known in the art.

In certain embodiments, the polynucleotide constructs of the invention are complexed in a liposome preparation. Liposomal preparations for use in the instant invention include cationic (positively charged), anionic (negatively charged) and neutral preparations. However, cationic liposomes are particularly preferred because a tight charge complex can be formed between the cationic liposome and the polyanionic nucleic acid. Cationic liposomes have been shown to mediate intracellular delivery of plasmid DNA (Feigner et al., Proc. Natl. Acad. Sci. USA, 84:7413-7416 (1987), which is herein incorporated by reference); mRNA (Malone et al., Proc. Natl. Acad. Sci. USA, 86:6077-6081 (1989), which is herein incorporated by reference); and purified transcription factors (Debs et al., J. Biol. Chem., 265:10189-10192 (1990), which is herein incorporated by reference), in functional form.

Cationic liposomes are readily available. For example, N[1-2,3-dioleyloxy)propyl]-N,N,N-triethylammonium (DOTMA) liposomes are particularly useful and are available under the trademark Lipofectin, from GIBCO BRL, Grand Island, N.Y. (See, also, Feigner et al., Proc. Natl. Acad. Sci. USA, 84:7413-7416 (1987), which is herein incorporated by reference). Other commercially available liposomes include transfectace (DDAB/DOPE) and DOTAP/DOPE (Boehringer).

Other cationic liposomes can be prepared from readily available materials using techniques well known in the art. See, e.g. PCT Publication NO: WO 90/11092 (which is herein incorporated by reference) for a description of the synthesis of DOTAP (1,2-bis(oleoyloxy)-3-(trimethylammonio)propane) liposomes. Preparation of DOTMA liposomes is explained in the literature, see, e.g., Feigner et al., Proc. Natl. Acad. Sci. USA, 84:7413-7417, which is herein incorporated by reference. Similar methods can be used to prepare liposomes from other cationic lipid materials.

Similarly, anionic and neutral liposomes are readily available, such as from Avanti Polar Lipids (Birmingham, Ala.), or can be easily prepared using readily available materials. Such materials include phosphatidyl, choline, cholesterol, phosphatidyl ethanolamine, dioleoylphosphatidyl choline (DOPC), dioleoylphosphatidyl glycerol (DOPG), dioleoylphoshatidyl ethanolamine (DOPE), among others. These materials can also be mixed with the DOTMA and DOTAP starting materials in appropriate ratios. Methods for making liposomes using these materials are well known in the art.

For example, commercially dioleoylphosphatidyl choline (DOPC), dioleoylphosphatidyl glycerol (DOPG), and dioleoylphosphatidyl ethanolamine (DOPE) can be used in various combinations to make conventional liposomes, with or without the addition of cholesterol. Thus, for example, DOPG/DOPC vesicles can be prepared by drying 50 mg each of DOPG and DOPC under a stream of nitrogen gas into a sonication vial. The sample is placed under a vacuum pump overnight and is hydrated the following day with deionized water. The sample is then sonicated for 2 hours in a capped vial, using a Heat Systems model 350 sonicator equipped with an inverted cup (bath type) probe at the maximum setting while the bath is circulated at 15EC. Alternatively, negatively charged vesicles can be prepared without sonication to produce multilamellar vesicles or by extrusion through nucleopore membranes to produce unilamellar vesicles of discrete size. Other methods are known and available to those of skill in the art.

The liposomes can comprise multilamellar vesicles (MLVs), small unilamellar vesicles (SUVs), or large unilamellar vesicles (LUVs), with SUVs being preferred. The various liposome-nucleic acid complexes are prepared using methods well known in the art. See, e.g., Straubinger et al., Methods of Immunology, 101:512-527 (1983), which is herein incorporated by reference. For example, MLVs containing nucleic acid can be prepared by depositing a thin film of phospholipid on the walls of a glass tube and subsequently hydrating with a solution of the material to be encapsulated. SUVs are prepared by extended sonication of MLVs to produce a homogeneous population of unilamellar liposomes. The material to be entrapped is added to a suspension of preformed MLVs and then sonicated. When using liposomes containing cationic lipids, the dried lipid film is resuspended in an appropriate solution such as sterile water or an isotonic buffer solution such as 10 mM Tris/NaCl, sonicated, and then the preformed liposomes are mixed directly with the DNA. The liposome and DNA form a very stable complex due to binding of the positively charged liposomes to the cationic DNA. SUVs find use with small nucleic acid fragments. LUVs are prepared by a number of methods, well known in the art. Commonly used methods include $Ca^{2+}$-EDTA chelation (Papahadjopoulos et al., Biochim. Biophys. Acta, 394: 483 (1975); Wilson et al., Cell, 17:77 (1979)); ether injection (Deamer et al., Biochim. Biophys. Acta, 443:629 (1976); Ostro et al., Biochem. Biophys. Res. Commun., 76:836 (1977); Fraley et al., Proc. Natl. Acad. Sci. USA, 76:3348 (1979)); detergent dialysis (Enoch et al., Proc. Natl. Acad. Sci. USA, 76:145 (1979)); and reverse-phase evaporation (REV) (Fraley et al., J. Biol. Chem., 255: 10431 (1980); Szoka et al., Proc. Natl. Acad. Sci. USA, 75:145 (1978); Schaefer-Ridder et al., Science, 215:166 (1982)), which are herein incorporated by reference.

Generally, the ratio of DNA to liposomes will be from about 10:1 to about 1:10. Preferably, the ration will be from about 5:1 to about 1:5. More preferably, the ration will be about 3:1 to about 1:3. Still more preferably, the ratio will be about 1:1.

U.S. Pat. No. 5,676,954 (which is herein incorporated by reference) reports on the injection of genetic material, complexed with cationic liposomes carriers, into mice. U.S. Pat. Nos. 4,897,355, 4,946,787, 5,049,386, 5,459,127, 5,589,466, 5,693,622, 5,580,859, 5,703,055, and international publication NO: WO 94/9469 (which are herein incorporated by reference) provide cationic lipids for use in transfecting DNA into cells and mammals. U.S. Pat. Nos. 5,589,466, 5,693,622, 5,580,859, 5,703,055, and international publication NO: WO 94/9469 (which are herein incorporated by reference) provide methods for delivering DNA-cationic lipid complexes to mammals.

In certain embodiments, cells are engineered, ex vivo or in vivo, using a retroviral particle containing RNA which comprises a sequence encoding polypeptides of the invention. Retroviruses from which the retroviral plasmid vectors may be derived include, but are not limited to, Moloney Murine Leukemia Virus, spleen necrosis virus, Rous sarcoma Virus, Harvey Sarcoma Virus, avian leukosis virus, gibbon ape leukemia virus, human immunodeficiency virus, Myeloproliferative Sarcoma Virus, and mammary tumor virus.

The retroviral plasmid vector is employed to transduce packaging cell lines to form producer cell lines. Examples of packaging cells which may be transfected include, but are not limited to, the PE501, PA317, R-2, R-AM, PA12, T19-14X, VT-19-17-H2, RCRE, RCRIP, GP+E-86, GP+envAm12, and DAN cell lines as described in Miller, Human Gene Therapy, 1:5-14 (1990), which is incorporated herein by reference in its entirety. The vector may transduce the packaging cells through any means known in the art. Such means include, but are not limited to, electroporation, the use of liposomes, and $CaPO_4$ precipitation. In one alternative, the retroviral plasmid vector may be encapsulated into a liposome, or coupled to a lipid, and then administered to a host.

The producer cell line generates infectious retroviral vector particles which include polynucleotide encoding polypeptides of the invention. Such retroviral vector particles then may be employed, to transduce eukaryotic cells, either in vitro or in vivo. The transduced eukaryotic cells will express polypeptides of the invention.

In certain other embodiments, cells are engineered, ex vivo or in vivo, with polynucleotides of the invention contained in an adenovirus vector. Adenovirus can be manipulated such that it encodes and expresses polypeptides of the invention, and at the same time is inactivated in terms of its ability to replicate in a normal lytic viral life cycle. Adenovirus expression is achieved without integration of the viral DNA into the host cell chromosome, thereby alleviating concerns about insertional mutagenesis. Furthermore, adenoviruses have been used as live enteric vaccines for many years with an excellent safety profile (Schwartz et al., Am. Rev. Respir. Dis., 109:233-238 (1974)). Finally, adenovirus mediated gene transfer has been demonstrated in a number of instances including transfer of alpha-1-antitrypsin and CFTR to the lungs of cotton rats (Rosenfeld et al., Science, 252:431-434 (1991); Rosenfeld et al., Cell, 68:143-155 (1992)). Furthermore, extensive studies to attempt to establish adenovirus as a causative agent in human cancer were uniformly negative (Green et al. Proc. Natl. Acad. Sci. USA, 76:6606 (1979)).

Suitable adenoviral vectors useful in the present invention are described, for example, in Kozarsky and Wilson, Curr. Opin. Genet. Devel., 3:499-503 (1993); Rosenfeld et al., Cell, 68:143-155 (1992); Engelhardt et al., Human Genet. Ther., 4:759-769 (1993); Yang et al., Nature Genet., 7:362-369 (1994); Wilson et al., Nature, 365:691-692 (1993); and U.S. Pat. No. 5,652,224, which are herein incorporated by reference. For example, the adenovirus vector Ad2 is useful and can be grown in human 293 cells. These cells contain the E1 region of adenovirus and constitutively express E1a and E1b, which complement the defective adenoviruses by providing the products of the genes deleted from the vector. In addition to Ad2, other varieties of adenovirus (e.g., Ad3, Ad5, and Ad7) are also useful in the present invention.

Preferably, the adenoviruses used in the present invention are replication deficient. Replication deficient adenoviruses require the aid of a helper virus and/or packaging cell line to form infectious particles. The resulting virus is capable of infecting cells and can express a polynucleotide of interest which is operably linked to a promoter, but cannot replicate in most cells. Replication deficient adenoviruses may be deleted in one or more of all or a portion of the following genes: E1a, E1b, E3, E4, E2a, or L1 through L5.

In certain other embodiments, the cells are engineered, ex vivo or in vivo, using an adeno-associated virus (AAV). AAVs are naturally occurring defective viruses that require helper viruses to produce infectious particles (Muzyczka, Curr. Topics in Microbiol. Immunol, 158:97 (1992)). It is also one of the few viruses that may integrate its DNA into non-dividing cells. Vectors containing as little as 300 base pairs of AAV can be packaged and can integrate, but space for exogenous DNA is limited to about 4.5 kb. Methods for producing and using such AAVs are known in the art. See, for example, U.S. Pat. Nos. 5,139,941, 5,173,414, 5,354,678, 5,436,146, 5,474,935, 5,478,745, and 5,589,377.

For example, an appropriate AAV vector for use in the present invention will include all the sequences necessary for DNA replication, encapsidation, and host-cell integration. The polynucleotide construct containing polynucleotides of the invention is inserted into the AAV vector using standard cloning methods, such as those found in Sambrook et al., Molecular Cloning: A Laboratory Manual, Cold Spring Harbor Press (1989). The recombinant AAV vector is then transfected into packaging cells which are infected with a helper virus, using any standard technique, including lipofection, electroporation, calcium phosphate precipitation, etc. Appropriate helper viruses include adenoviruses, cytomegaloviruses, vaccinia viruses, or herpes viruses. Once the packaging cells are transfected and infected, they will produce infectious AAV viral particles which contain the polynucleotide construct of the invention. These viral particles are then used to transduce eukaryotic cells, either ex vivo or in vivo. The transduced cells will contain the polynucleotide construct integrated into its genome, and will express the desired gene product.

Another method of gene therapy involves operably associating heterologous control regions and endogenous polynucleotide sequences (e.g. encoding the polypeptide sequence of interest) via homologous recombination (see, e.g., U.S. Pat. No. 5,641,670, issued Jun. 24, 1997; International Publication NO: WO 96/29411, published Sep. 26, 1996; International Publication NO: WO 94/12650, published Aug. 4, 1994; Koller et al., Proc. Natl. Acad. Sci. USA, 86:8932-8935 (1989); and Zijlstra et al., Nature, 342:435-438 (1989). This method involves the activation of a gene which is present in the target cells, but which is not normally expressed in the cells, or is expressed at a lower level than desired.

Polynucleotide constructs are made, using standard techniques known in the art, which contain the promoter with targeting sequences flanking the promoter. Suitable promoters are described herein. The targeting sequence is sufficiently complementary to an endogenous sequence to permit homologous recombination of the promoter-targeting sequence with the endogenous sequence. The targeting sequence will be sufficiently near the 5' end of the desired endogenous polynucleotide sequence so the promoter will be operably linked to the endogenous sequence upon homologous recombination.

The promoter and the targeting sequences can be amplified using PCR. Preferably, the amplified promoter contains distinct restriction enzyme sites on the 5' and 3' ends. Preferably, the 3' end of the first targeting sequence contains the same restriction enzyme site as the 5' end of the amplified promoter and the 5' end of the second targeting sequence contains the same restriction site as the 3' end of the amplified promoter. The amplified promoter and targeting sequences are digested and ligated together.

The promoter-targeting sequence construct is delivered to the cells, either as naked polynucleotide, or in conjunction with transfection-facilitating agents, such as liposomes, viral sequences, viral particles, whole viruses, lipofection, precipitating agents, etc., described in more detail above. The P promoter-targeting sequence can be delivered by any method, included direct needle injection, intravenous injection, topical administration, catheter infusion, particle accelerators, etc. The methods are described in more detail below.

The promoter-targeting sequence construct is taken up by cells. Homologous recombination between the construct and the endogenous sequence takes place, such that an endogenous sequence is placed under the control of the promoter. The promoter then drives the expression of the endogenous sequence.

The polynucleotides encoding polypeptides of the present invention may be administered along with other polynucleotides encoding other angiongenic proteins. Angiogenic proteins include, but are not limited to, acidic and basic fibroblast growth factors, VEGF-1, VEGF-2 (VEGF-C), VEGF-3 (VEGF-B), epidermal growth factor alpha and beta, platelet-derived endothelial cell growth factor, platelet-derived growth factor, tumor necrosis factor alpha, hepatocyte growth factor, insulin like growth factor, colony stimulating factor, macrophage colony stimulating factor, granulocyte/macrophage colony stimulating factor, and nitric oxide synthase.

Preferably, the polynucleotide encoding a polypeptide of the invention contains a secretory signal sequence that facilitates secretion of the protein. Typically, the signal sequence is positioned in the coding region of the polynucleotide to be expressed towards or at the 5' end of the coding region. The signal sequence may be homologous or heterologous to the polynucleotide of interest and may be homologous or heterologous to the cells to be transfected. Additionally, the signal sequence may be chemically synthesized using methods known in the art.

Any mode of administration of any of the above-described polynucleotides constructs can be used so long as the mode results in the expression of one or more molecules in an amount sufficient to provide a therapeutic effect. This includes direct needle injection, systemic injection, catheter infusion, biolistic injectors, particle accelerators (i.e., "gene guns"), gelfoam sponge depots, other commercially available depot materials, osmotic pumps (e.g., Alza minipumps), oral or suppositorial solid (tablet or pill) pharmaceutical formulations, and decanting or topical applications during surgery. For example, direct injection of naked calcium phosphate-precipitated plasmid into rat liver and rat spleen or a protein-coated plasmid into the portal vein has resulted in gene expression of the foreign gene in the rat livers. (Kaneda et al., Science, 243:375 (1989)).

A preferred method of local administration is by direct injection. Preferably, a recombinant molecule of the present invention complexed with a delivery vehicle is administered by direct injection into or locally within the area of arteries. Administration of a composition locally within the area of arteries refers to injecting the composition centimeters and preferably, millimeters within arteries.

Another method of local administration is to contact a polynucleotide construct of the present invention in or around a surgical wound. For example, a patient can undergo surgery and the polynucleotide construct can be coated on the surface of tissue inside the wound or the construct can be injected into areas of tissue inside the wound.

Therapeutic compositions useful in systemic administration, include recombinant molecules of the present invention complexed to a targeted delivery vehicle of the present invention. Suitable delivery vehicles for use with systemic administration comprise liposomes comprising ligands for targeting the vehicle to a particular site.

Preferred methods of systemic administration, include intravenous injection, aerosol, oral and percutaneous (topical) delivery. Intravenous injections can be performed using methods standard in the art. Aerosol delivery can also be performed using methods standard in the art (see, for example, Stribling et al., Proc. Natl. Acad. Sci. USA, 189: 11277-11281 (1992), which is incorporated herein by reference). Oral delivery can be performed by complexing a polynucleotide construct of the present invention to a carrier capable of withstanding degradation by digestive enzymes in the gut of an animal. Examples of such carriers, include plastic capsules or tablets, such as those known in the art. Topical delivery can be performed by mixing a polynucleotide construct of the present invention with a lipophilic reagent (e.g., DMSO) that is capable of passing into the skin.

Determining an effective amount of substance to be delivered can depend upon a number of factors including, for example, the chemical structure and biological activity of the substance, the age and weight of the animal, the precise condition requiring treatment and its severity, and the route of administration. The frequency of treatments depends upon a number of factors, such as the amount of polynucleotide constructs administered per dose, as well as the health and history of the subject. The precise amount, number of doses, and timing of doses will be determined by the attending physician or veterinarian. Therapeutic compositions of the present invention can be administered to any animal, preferably to mammals and birds. Preferred mammals include humans, dogs, cats, mice, rats, rabbits sheep, cattle, horses and pigs, with humans being particularly.

Biological Activities

The polynucleotides or polypeptides, or agonists or antagonists of the present invention can be used in assays to test for one or more biological activities. If these polynucleotides and polypeptides do exhibit activity in a particular assay, it is likely that these molecules may be involved in the diseases associated with the biological activity. Thus, the polynucleotides or polypeptides, or agonists or antagonists could be used to treat the associated disease.

More generally, polynucleotides, translation products and antibodies corresponding to this gene may be useful for the diagnosis, prognosis, prevention, and/or treatment of diseases and/or disorders associated with the following systems.

Immune Activity

Polynucleotides, polypeptides, antibodies, and/or agonists or antagonists of the present invention may be useful in treating, preventing, diagnosing and/or prognosing diseases, disorders, and/or conditions of the immune system, by, for example, activating or inhibiting the proliferation, differentiation, or mobilization (chemotaxis) of immune cells Immune cells develop through a process called hematopoiesis, producing myeloid (platelets, red blood cells, neutrophils, and macrophages) and lymphoid (B and T lymphocytes) cells from pluripotent stem cells. The etiology of these immune diseases, disorders, and/or conditions may be genetic, somatic, such as cancer and some autoimmune diseases, acquired (e.g., by chemotherapy or toxins), or infectious. Moreover, polynucleotides, polypeptides, antibodies, and/or agonists or antagonists of the present invention can be used as a marker or detector of a particular immune system disease or disorder.

In another embodiment, a polypeptide of the invention, or polynucleotides, antibodies, agonists, or antagonists corresponding to that polypeptide, may be used to treat diseases and disorders of the immune system and/or to inhibit or enhance an immune response generated by cells associated with the tissue(s) in which the polypeptide of the invention is expressed, including one, two, three, four, five, or more tissues disclosed in Table 1A, column 8 (Tissue Distribution Library Code).

Polynucleotides, polypeptides, antibodies, and/or agonists or antagonists of the present invention may be useful in treating, preventing, diagnosing, and/or prognosing immunodeficiencies, including both congenital and acquired immunodeficiencies. Examples of B cell immunodeficiencies in which immunoglobulin levels B cell function and/or B cell numbers are decreased include: X-linked agammaglobulinemia (Bruton's disease), X-linked infantile agammaglobulinemia, X-linked immunodeficiency with hyper IgM, non X-linked immunodeficiency with hyper IgM, X-linked lymphoproliferative syndrome (XLP), agammaglobulinemia including congenital and acquired agammaglobulinemia, adult onset agammaglobulinemia, late-onset agammaglobulinemia, dysgammaglobulinemia, hypogammaglobulinemia, unspecified hypogammaglobulinemia, recessive agammaglobulinemia (Swiss type), Selective IgM deficiency, selective IgA deficiency, selective IgG subclass deficiencies, IgG subclass deficiency (with or without IgA deficiency), Ig deficiency with increased IgM, IgG and IgA deficiency with increased IgM, antibody deficiency with normal or elevated Igs, Ig heavy chain deletions, kappa chain deficiency, B cell lymphoproliferative disorder (BLPD), common variable immunodeficiency (CVID), common variable immunodeficiency (CV1) (acquired), and transient hypogammaglobulinemia of infancy.

In specific embodiments, ataxia-telangiectasia or conditions associated with ataxia-telangiectasia are treated, prevented, diagnosed, and/or prognosing using the polypeptides or polynucleotides of the invention, and/or agonists or antagonists thereof.

Examples of congenital immunodeficiencies in which T cell and/or B cell function and/or number is decreased include, but are not limited to: DiGeorge anomaly, severe combined immunodeficiencies (SCID) (including, but not limited to, X-linked SCID, autosomal recessive SCID, adenosine deaminase deficiency, purine nucleoside phosphorylase (PNP) deficiency, Class II MHC deficiency (Bare lymphocyte syndrome), Wiskott-Aldrich syndrome, and ataxia telangiectasia), thymic hypoplasia, third and fourth pharyngeal pouch syndrome, 22q11.2 deletion, chronic mucocutaneous candidiasis, natural killer cell deficiency (NK), idiopathic CD4+ T-lymphocytopenia, immunodeficiency with predominant T cell defect (unspecified), and unspecified immunodeficiency of cell mediated immunity In specific embodiments, DiGeorge anomaly or conditions associated with DiGeorge anomaly are treated, prevented, diagnosed, and/or prognosed using polypeptides or polynucleotides of the invention, or antagonists or agonists thereof.

Other immunodeficiencies that may be treated, prevented, diagnosed, and/or prognosed using polypeptides or polynucleotides of the invention, and/or agonists or antagonists thereof, include, but are not limited to, chronic granulomatous disease, Chediak-Higashi syndrome, myeloperoxidase deficiency, leukocyte glucose-6-phosphate dehydrogenase deficiency, X-linked lymphoproliferative syndrome (XLP), leukocyte adhesion deficiency, complement component deficiencies (including C1, C2, C3, C4, C5, C6, C7, C8 and/or C9 deficiencies), reticular dysgenesis, thymic alymphoplasia-aplasia, immunodeficiency with thymoma, severe congenital leukopenia, dysplasia with immunodeficiency, neonatal neutropenia, short limbed dwarfism, and Nezelof syndrome-combined immunodeficiency with Igs.

In a preferred embodiment, the immunodeficiencies and/or conditions associated with the immunodeficiencies recited above are treated, prevented, diagnosed and/or prognosed using polynucleotides, polypeptides, antibodies, and/or agonists or antagonists of the present invention.

In a preferred embodiment polynucleotides, polypeptides, antibodies, and/or agonists or antagonists of the present invention could be used as an agent to boost immunoresponsiveness among immunodeficient individuals. In specific embodiments, polynucleotides, polypeptides, antibodies, and/or agonists or antagonists of the present invention could be used as an agent to boost immunoresponsiveness among B cell and/or T cell immunodeficient individuals.

The polynucleotides, polypeptides, antibodies, and/or agonists or antagonists of the present invention may be useful in treating, preventing, diagnosing and/or prognosing autoimmune disorders. Many autoimmune disorders result from inappropriate recognition of self as foreign material by immune cells. This inappropriate recognition results in an immune response leading to the destruction of the host tissue. Therefore, the administration of polynucleotides and polypeptides of the invention that can inhibit an immune response, particularly the proliferation, differentiation, or chemotaxis of T-cells, may be an effective therapy in preventing autoimmune disorders.

Autoimmune diseases or disorders that may be treated, prevented, diagnosed and/or prognosed by polynucleotides, polypeptides, antibodies, and/or agonists or antagonists of the present invention include, but are not limited to, one or more of the following: systemic lupus erythematosus, rheumatoid arthritis, ankylosing spondylitis, multiple sclerosis, autoimmune thyroiditis, Hashimoto's thyroiditis, autoimmune hemolytic anemia, hemolytic anemia, thrombocytopenia, autoimmune thrombocytopenia purpura, autoimmune neonatal thrombocytopenia, idiopathic thrombocytopenia purpura, purpura (e.g., Henloch-Scoenlein purpura), autoimmunocytopenia, Goodpasture's syndrome, Pemphigus vulgaris, myasthenia gravis, Grave's disease (hyperthyroidism), and insulin-resistant diabetes mellitus.

Additional disorders that are likely to have an autoimmune component that may be treated, prevented, and/or diagnosed with the compositions of the invention include, but are not limited to, type II collagen-induced arthritis, antiphospholipid syndrome, dermatitis, allergic encephalomyelitis, myocarditis, relapsing polychondritis, rheumatic heart disease, neuritis, uveitis ophthalmia, polyendocrinopathies, Reiter's Disease, Stiff-Man Syndrome, autoimmune pulmonary inflammation, autism, Guillain-Barre Syndrome, insulin dependent diabetes mellitus, and autoimmune inflammatory eye disorders.

Additional disorders that are likely to have an autoimmune component that may be treated, prevented, diagnosed and/or prognosed with the compositions of the invention include, but are not limited to, scleroderma with anti-collagen antibodies (often characterized, e.g., by nucleolar and other nuclear antibodies), mixed connective tissue disease (often characterized, e.g., by antibodies to extractable nuclear antigens (e.g., ribonucleoprotein)), polymyositis (often characterized, e.g., by nonhistone ANA), pernicious anemia (often characterized, e.g., by antiparietal cell, microsomes, and intrinsic factor antibodies), idiopathic Addison's disease (often characterized, e.g., by humoral and cell-mediated adrenal cytotoxicity, infertility (often characterized, e.g., by antispermatozoal antibodies), glomerulonephritis (often characterized, e.g., by glomerular basement membrane antibodies or immune complexes), bullous pemphigoid (often characterized, e.g., by IgG and complement in basement membrane), Sjogren's syndrome (often characterized, e.g., by multiple tissue antibodies, and/or a specific nonhistone ANA (SS-B)), diabetes mellitus (often characterized, e.g., by cell-mediated and humoral islet cell antibodies), and adrenergic drug resistance (including adrenergic drug resistance with asthma or cystic fibrosis) (often characterized, e.g., by beta-adrenergic receptor antibodies).

Additional disorders that may have an autoimmune component that may be treated, prevented, diagnosed and/or prognosed with the compositions of the invention include, but are not limited to, chronic active hepatitis (often characterized, e.g., by smooth muscle antibodies), primary biliary cirrhosis (often characterized, e.g., by mitochondria antibodies), other endocrine gland failure (often characterized, e.g., by specific tissue antibodies in some cases), vitiligo (often characterized, e.g., by melanocyte antibodies), vasculitis (often characterized, e.g., by Ig and complement in vessel walls and/or low serum complement), post-MI (often characterized, e.g., by myocardial antibodies), cardiotomy syndrome (often characterized, e.g., by myocardial antibodies), urticaria (often characterized, e.g., by IgG and IgM antibodies to IgE), atopic dermatitis (often characterized, e.g., by IgG and IgM antibodies to IgE), asthma (often characterized, e.g., by IgG and IgM antibodies to IgE), and many other inflammatory, granulomatous, degenerative, and atrophic disorders.

In a preferred embodiment, the autoimmune diseases and disorders and/or conditions associated with the diseases and disorders recited above are treated, prevented, diagnosed and/or prognosed using for example, antagonists or agonists, polypeptides or polynucleotides, or antibodies of the present invention. In a specific preferred embodiment, rheumatoid arthritis is treated, prevented, and/or diagnosed using polynucleotides, polypeptides, antibodies, and/or agonists or antagonists of the present invention.

In another specific preferred embodiment, systemic lupus erythematosus is treated, prevented, and/or diagnosed using polynucleotides, polypeptides, antibodies, and/or agonists or antagonists of the present invention.

In another specific preferred embodiment, idiopathic thrombocytopenia purpura is treated, prevented, and/or diagnosed using polynucleotides, polypeptides, antibodies, and/or agonists or antagonists of the present invention.

In another specific preferred embodiment IgA nephropathy is treated, prevented, and/or diagnosed using polynucleotides, polypeptides, antibodies, and/or agonists or antagonists of the present invention.

In a preferred embodiment, the autoimmune diseases and disorders and/or conditions associated with the diseases and disorders recited above are treated, prevented, diagnosed and/or prognosed using polynucleotides, polypeptides, antibodies, and/or agonists or antagonists of the present invention In preferred embodiments, polypeptides, antibodies, polynucleotides and/or agonists or antagonists of the present invention are used as a immunosuppressive agent(s).

Polynucleotides, polypeptides, antibodies, and/or agonists or antagonists of the present invention may be useful in treating, preventing, prognosing, and/or diagnosing diseases, disorders, and/or conditions of hematopoietic cells. Polynucleotides, polypeptides, antibodies, and/or agonists or antagonists of the present invention could be used to increase differentiation and proliferation of hematopoietic cells, including the pluripotent stem cells, in an effort to treat or prevent those diseases, disorders, and/or conditions associated with a decrease in certain (or many) types hematopoietic cells, including but not limited to, leukopenia, neutropenia, anemia, and thrombocytopenia. Alternatively, Polynucleotides, polypeptides, antibodies, and/or agonists or antagonists of the present invention could be used to increase differentiation and proliferation of hematopoietic cells, including the pluripotent stem cells, in an effort to treat or prevent those diseases, disorders, and/or conditions associated with an increase in certain (or many) types of hematopoietic cells, including but not limited to, histiocytosis.

Allergic reactions and conditions, such as asthma (particularly allergic asthma) or other respiratory problems, may also be treated, prevented, diagnosed and/or prognosed using polypeptides, antibodies, or polynucleotides of the invention, and/or agonists or antagonists thereof. Moreover, these molecules can be used to treat, prevent, prognose, and/or diagnose anaphylaxis, hypersensitivity to an antigenic molecule, or blood group incompatibility.

Additionally, polypeptides or polynucleotides of the invention, and/or agonists or antagonists thereof, may be used to treat, prevent, diagnose and/or prognose IgE-mediated allergic reactions. Such allergic reactions include, but are not limited to, asthma, rhinitis, and eczema. In specific embodiments, polynucleotides, polypeptides, antibodies, and/or agonists or antagonists of the present invention may be used to modulate IgE concentrations in vitro or in vivo.

Moreover, polynucleotides, polypeptides, antibodies, and/or agonists or antagonists of the present invention have uses in the diagnosis, prognosis, prevention, and/or treatment of inflammatory conditions. For example, since polypeptides, antibodies, or polynucleotides of the invention, and/or agonists or antagonists of the invention may inhibit the activation, proliferation and/or differentiation of cells involved in an inflammatory response, these molecules can be used to prevent and/or treat chronic and acute inflammatory conditions. Such inflammatory conditions include, but are not limited to, for example, inflammation associated with infection (e.g., septic shock, sepsis, or systemic inflammatory response syndrome), ischemia-reperfusion injury, endotoxin lethality, complement-mediated hyperacute rejection, nephritis, cytokine or chemokine induced lung injury, inflammatory bowel disease, Crohn's disease, over production of cytokines (e.g., TNF or IL-1.), respiratory disorders (e.g., asthma and allergy); gastrointestinal disorders (e.g., inflammatory bowel disease); cancers (e.g., gastric, ovarian, lung, bladder, liver, and breast); CNS disorders (e.g., multiple sclerosis; ischemic brain injury and/or stroke, traumatic brain injury, neurodegenerative disorders (e.g., Parkinson's disease and Alzheimer's disease); AIDS-related dementia; and prion disease); cardiovascular disorders (e.g., atherosclerosis, myocarditis, cardiovascular disease, and cardiopulmonary bypass complications); as well as many additional diseases, conditions, and disorders that are characterized by inflammation (e.g., hepatitis, rheumatoid arthritis, gout, trauma, pancreatitis, sarcoidosis, dermatitis, renal ischemia-reperfusion injury, Grave's disease, systemic lupus erythematosus, diabetes mellitus, and allogenic transplant rejection).

Because inflammation is a fundamental defense mechanism, inflammatory disorders can effect virtually any tissue of the body. Accordingly, polynucleotides, polypeptides, and antibodies of the invention, as well as agonists or antagonists thereof, have uses in the treatment of tissue-specific inflammatory disorders, including, but not limited to, adrenalitis, alveolitis, angiocholecystitis, appendicitis, balanitis, blepharitis, bronchitis, bursitis, carditis, cellulitis, cervicitis, cholecystitis, chorditis, cochlitis, colitis, conjunctivitis, cystitis, dermatitis, diverticulitis, encephalitis, endocarditis, esophagitis, eustachitis, fibrositis, folliculitis, gastritis, gastroenteritis, gingivitis, glossitis, hepatosplenitis, keratitis, labyrinthitis, laryngitis, lymphangitis, mastitis, media otitis, meningitis, metritis, mucitis, myocarditis, myositis, myringitis, nephritis, neuritis, orchitis, osteochondritis, otitis, pericarditis, peritendonitis, peritonitis, pharyngitis, phlebitis, poliomyelitis, prostatitis, pulpitis, retinitis, rhinitis, salpingitis, scleritis, sclerochoroiditis, scrotitis, sinusitis, spondylitis, steatitis, stomatitis, synovitis, syringitis, tendonitis, tonsillitis, urethritis, and vaginitis.

In specific embodiments, polypeptides, antibodies, or polynucleotides of the invention, and/or agonists or antagonists thereof, are useful to diagnose, prognose, prevent, and/or treat organ transplant rejections and graft-versus-host disease. Organ rejection occurs by host immune cell destruction of the transplanted tissue through an immune response. Similarly, an immune response is also involved in GVHD, but, in this case, the foreign transplanted immune cells destroy the host tissues. Polypeptides, antibodies, or polynucleotides of the invention, and/or agonists or antagonists thereof, that inhibit an immune response, particularly the activation, proliferation, differentiation, or chemotaxis of T-cells, may be an effective therapy in preventing organ rejection or GVHD. In specific embodiments, polypeptides, antibodies, or polynucleotides of the invention, and/or agonists or antagonists thereof, that inhibit an immune response, particularly the activation, proliferation, differentiation, or chemotaxis of T-cells, may be an effective therapy in preventing experimental allergic and hyperacute xenograft rejection.

In other embodiments, polypeptides, antibodies, or polynucleotides of the invention, and/or agonists or antagonists thereof, are useful to diagnose, prognose, prevent, and/or treat immune complex diseases, including, but not limited to, serum sickness, post streptococcal glomerulonephritis, polyarteritis nodosa, and immune complex-induced vasculitis.

Polypeptides, antibodies, polynucleotides and/or agonists or antagonists of the invention can be used to treat, detect, and/or prevent infectious agents. For example, by increasing the immune response, particularly increasing the proliferation activation and/or differentiation of B and/or T cells, infectious diseases may be treated, detected, and/or prevented. The immune response may be increased by either enhancing an existing immune response, or by initiating a new immune response. Alternatively, polynucleotides, polypeptides, antibodies, and/or agonists or antagonists of the present invention may also directly inhibit the infectious agent (refer to section of application listing infectious agents, etc), without necessarily eliciting an immune response.

In another embodiment, polypeptides, antibodies, polynucleotides and/or agonists or antagonists of the present invention are used as a vaccine adjuvant that enhances immune responsiveness to an antigen. In a specific embodiment, polypeptides, antibodies, polynucleotides and/or agonists or antagonists of the present invention are used as an adjuvant to enhance tumor-specific immune responses.

In another specific embodiment, polypeptides, antibodies, polynucleotides and/or agonists or antagonists of the present invention are used as an adjuvant to enhance anti-viral immune responses. Anti-viral immune responses that may be enhanced using the compositions of the invention as an adjuvant, include virus and virus associated diseases or symptoms described herein or otherwise known in the art. In specific embodiments, the compositions of the invention are used as an adjuvant to enhance an immune response to a virus, disease, or symptom selected from the group consisting of: AIDS, meningitis, Dengue, EBV, and hepatitis (e.g., hepatitis B). In another specific embodiment, the compositions of the invention are used as an adjuvant to enhance an immune response to a virus, disease, or symptom selected from the group consisting of: HIV/AIDS, respiratory syncytial virus, Dengue, rotavirus, Japanese B encephalitis, influenza A and B, parainfluenza, measles, cytomegalovirus, rabies, Junin, Chikungunya, Rift Valley Fever, herpes simplex, and yellow fever.

In another specific embodiment, polypeptides, antibodies, polynucleotides and/or agonists or antagonists of the present invention are used as an adjuvant to enhance anti-bacterial or anti-fungal immune responses. Anti-bacterial or anti-fungal immune responses that may be enhanced using the compositions of the invention as an adjuvant, include bacteria or fungus and bacteria or fungus associated diseases or symptoms described herein or otherwise known in the art. In specific embodiments, the compositions of the invention are used as an adjuvant to enhance an immune response to a bacteria or fungus, disease, or symptom selected from the group consisting of: tetanus, Diphtheria, botulism, and meningitis type B.

In another specific embodiment, the compositions of the invention are used as an adjuvant to enhance an immune response to a bacteria or fungus, disease, or symptom selected from the group consisting of: *Vibrio cholerae, Mycobacterium leprae, Salmonella typhi, Salmonella paratyphi, Meisseria meningitidis, Streptococcus pneumoniae,* Group B *streptococcus, Shigella* spp., Enterotoxigenic *Escherichia coli,* Enterohemorrhagic *E. coli,* and *Borrelia burgdorferi.*

In another specific embodiment, polypeptides, antibodies, polynucleotides and/or agonists or antagonists of the present invention are used as an adjuvant to enhance anti-parasitic immune responses. Anti-parasitic immune responses that may be enhanced using the compositions of the invention as an adjuvant, include parasite and parasite associated diseases or symptoms described herein or otherwise known in the art. In specific embodiments, the compositions of the invention are used as an adjuvant to enhance an immune response to a parasite. In another specific embodiment, the compositions of the invention are used as an adjuvant to enhance an immune response to *Plasmodium* (malaria) or *Leishmania.*

In another specific embodiment, polypeptides, antibodies, polynucleotides and/or agonists or antagonists of the present invention may also be employed to treat infectious diseases including silicosis, sarcoidosis, and idiopathic pulmonary fibrosis; for example, by preventing the recruitment and activation of mononuclear phagocytes.

In another specific embodiment, polypeptides, antibodies, polynucleotides and/or agonists or antagonists of the present invention are used as an antigen for the generation of antibodies to inhibit or enhance immune mediated responses against polypeptides of the invention.

In one embodiment, polypeptides, antibodies, polynucleotides and/or agonists or antagonists of the present invention are administered to an animal (e.g., mouse, rat, rabbit, hamster, guinea pig, pigs, micro-pig, chicken, camel, goat, horse, cow, sheep, dog, cat, non-human primate, and human, most preferably human) to boost the immune system to produce increased quantities of one or more antibodies (e.g., IgG, IgA, IgM, and IgE), to induce higher affinity antibody production and immunoglobulin class switching (e.g., IgG, IgA, IgM, and IgE), and/or to increase an immune response.

In another specific embodiment, polypeptides, antibodies, polynucleotides and/or agonists or antagonists of the present invention are used as a stimulator of B cell responsiveness to pathogens.

In another specific embodiment, polypeptides, antibodies, polynucleotides and/or agonists or antagonists of the present invention are used as an activator of T cells.

In another specific embodiment, polypeptides, antibodies, polynucleotides and/or agonists or antagonists of the present invention are used as an agent that elevates the immune status of an individual prior to their receipt of immunosuppressive therapies.

In another specific embodiment, polypeptides, antibodies, polynucleotides and/or agonists or antagonists of the present invention are used as an agent to induce higher affinity antibodies.

In another specific embodiment, polypeptides, antibodies, polynucleotides and/or agonists or antagonists of the present invention are used as an agent to increase serum immunoglobulin concentrations.

In another specific embodiment, polypeptides, antibodies, polynucleotides and/or agonists or antagonists of the present invention are used as an agent to accelerate recovery of immunocompromised individuals.

In another specific embodiment, polypeptides, antibodies, polynucleotides and/or agonists or antagonists of the present invention are used as an agent to boost immunoresponsiveness among aged populations and/or neonates.

In another specific embodiment, polypeptides, antibodies, polynucleotides and/or agonists or antagonists of the present invention are used as an immune system enhancer prior to, during, or after bone marrow transplant and/or other transplants (e.g., allogeneic or xenogeneic organ transplantation). With respect to transplantation, compositions of the invention may be administered prior to, concomitant with, and/or after transplantation. In a specific embodiment, compositions of the invention are administered after transplantation, prior to the beginning of recovery of T-cell populations. In another specific embodiment, compositions of the invention are first administered after transplantation after the beginning of recovery of T cell populations, but prior to full recovery of B cell populations.

In another specific embodiment, polypeptides, antibodies, polynucleotides and/or agonists or antagonists of the present invention are used as an agent to boost immunoresponsiveness among individuals having an acquired loss of B cell function. Conditions resulting in an acquired loss of B cell function that may be ameliorated or treated by administering the polypeptides, antibodies, polynucleotides and/or agonists or antagonists thereof, include, but are not limited to, HIV Infection, AIDS, bone marrow transplant, and B cell chronic lymphocytic leukemia (CLL).

In another specific embodiment, polypeptides, antibodies, polynucleotides and/or agonists or antagonists of the present invention are used as an agent to boost immunoresponsiveness among individuals having a temporary immune deficiency. Conditions resulting in a temporary immune deficiency that may be ameliorated or treated by administering the polypeptides, antibodies, polynucleotides and/or agonists or antagonists thereof, include, but are not limited to, recovery from viral infections (e.g., influenza), conditions associated with malnutrition, recovery from infectious mononucleosis, or conditions associated with stress, recovery from measles, recovery from blood transfusion, and recovery from surgery.

In another specific embodiment, polypeptides, antibodies, polynucleotides and/or agonists or antagonists of the present invention are used as a regulator of antigen presentation by monocytes, dendritic cells, and/or B-cells. In one embodiment, polynucleotides, polypeptides, antibodies, and/or agonists or antagonists of the present invention enhance antigen presentation or antagonizes antigen presentation in vitro or in vivo. Moreover, in related embodiments, said enhancement or antagonism of antigen presentation may be useful as an anti-tumor treatment or to modulate the immune system.

In another specific embodiment, polypeptides, antibodies, polynucleotides and/or agonists or antagonists of the present invention are used as an agent to direct an individual's immune system towards development of a humoral response (i.e. TH2) as opposed to a TH1 cellular response.

In another specific embodiment, polypeptides, antibodies, polynucleotides and/or agonists or antagonists of the present invention are used as a means to induce tumor proliferation and thus make it more susceptible to anti-neoplastic agents. For example, multiple myeloma is a slowly dividing disease and is thus refractory to virtually all anti-neoplastic regimens. If these cells were forced to proliferate more rapidly their susceptibility profile would likely change.

In another specific embodiment, polypeptides, antibodies, polynucleotides and/or agonists or antagonists of the present invention are used as a stimulator of B cell production in pathologies such as AIDS, chronic lymphocyte disorder and/or Common Variable Immunodificiency.

In another specific embodiment, polypeptides, antibodies, polynucleotides and/or agonists or antagonists of the present invention are used as a therapy for generation and/or regeneration of lymphoid tissues following surgery, trauma or genetic defect. In another specific embodiment, polypeptides, antibodies, polynucleotides and/or agonists or antagonists of the present invention are used in the pretreatment of bone marrow samples prior to transplant.

In another specific embodiment, polypeptides, antibodies, polynucleotides and/or agonists or antagonists of the present invention are used as a gene-based therapy for genetically inherited disorders resulting in immuno-incompetence/immunodeficiency such as observed among SCID patients.

In another specific embodiment, polypeptides, antibodies, polynucleotides and/or agonists or antagonists of the present invention are used as a means of activating monocytes/macrophages to defend against parasitic diseases that effect monocytes such as *Leishmania*.

In another specific embodiment, polypeptides, antibodies, polynucleotides and/or agonists or antagonists of the present invention are used as a means of regulating secreted cytokines that are elicited by polypeptides of the invention.

In another embodiment, polypeptides, antibodies, polynucleotides and/or agonists or antagonists of the present invention are used in one or more of the applications described herein, as they may apply to veterinary medicine.

In another specific embodiment, polypeptides, antibodies, polynucleotides and/or agonists or antagonists of the present invention are used as a means of blocking various aspects of immune responses to foreign agents or self. Examples of diseases or conditions in which blocking of certain aspects of immune responses may be desired include autoimmune disorders such as lupus, and arthritis, as well as immunoresponsiveness to skin allergies, inflammation, bowel disease, injury and diseases/disorders associated with pathogens.

In another specific embodiment, polypeptides, antibodies, polynucleotides and/or agonists or antagonists of the present invention are used as a therapy for preventing the B cell proliferation and Ig secretion associated with autoimmune diseases such as idiopathic thrombocytopenic purpura, systemic lupus erythematosus and multiple sclerosis.

In another specific embodiment, polypeptides, antibodies, polynucleotides and/or agonists or antagonists of the present invention are used as a inhibitor of B and/or T cell migration in endothelial cells. This activity disrupts tissue architecture or cognate responses and is useful, for example in disrupting immune responses, and blocking sepsis.

In another specific embodiment, polypeptides, antibodies, polynucleotides and/or agonists or antagonists of the present invention are used as a therapy for chronic hypergammaglobulinemia evident in such diseases as monoclonal gammopathy of undetermined significance (MGUS), Waldenstrom's disease, related idiopathic monoclonal gammopathies, and plasmacytomas.

In another specific embodiment, polypeptides, antibodies, polynucleotides and/or agonists or antagonists of the present invention may be employed for instance to inhibit polypeptide chemotaxis and activation of macrophages and their precursors, and of neutrophils, basophils, B lymphocytes and some T-cell subsets, e.g., activated and CD8 cytotoxic T cells and natural killer cells, in certain autoimmune and chronic inflammatory and infective diseases. Examples of autoimmune diseases are described herein and include multiple sclerosis, and insulin-dependent diabetes.

The polypeptides, antibodies, polynucleotides and/or agonists or antagonists of the present invention may also be employed to treat idiopathic hyper-eosinophilic syndrome by, for example, preventing eosinophil production and migration.

In another specific embodiment, polypeptides, antibodies, polynucleotides and/or agonists or antagonists of the present invention are used to enhance or inhibit complement mediated cell lysis.

In another specific embodiment, polypeptides, antibodies, polynucleotides and/or agonists or antagonists of the present invention are used to enhance or inhibit antibody dependent cellular cytotoxicity.

In another specific embodiment, polypeptides, antibodies, polynucleotides and/or agonists or antagonists of the present invention may also be employed for treating atherosclerosis, for example, by preventing monocyte infiltration in the artery wall.

In another specific embodiment, polypeptides, antibodies, polynucleotides and/or agonists or antagonists of the present invention may be employed to treat adult respiratory distress syndrome (ARDS).

In another specific embodiment, polypeptides, antibodies, polynucleotides and/or agonists or antagonists of the present invention may be useful for stimulating wound and tissue repair, stimulating angiogenesis, and/or stimulating the repair of vascular or lymphatic diseases or disorders. Additionally, agonists and antagonists of the invention may be used to stimulate the regeneration of mucosal surfaces.

In a specific embodiment, polynucleotides or polypeptides, and/or agonists thereof are used to diagnose, prognose, treat, and/or prevent a disorder characterized by primary or acquired immunodeficiency, deficient serum immunoglobulin production, recurrent infections, and/or immune system dysfunction. Moreover, polynucleotides or polypeptides, and/or agonists thereof may be used to treat or prevent infections of the joints, bones, skin, and/or parotid glands, blood-borne infections (e.g., sepsis, meningitis, septic arthritis, and/or osteomyelitis), autoimmune diseases (e.g., those disclosed herein), inflammatory disorders, and malignancies, and/or any disease or disorder or condition associated with these infections, diseases, disorders and/or malignancies) including, but not limited to, CVID, other primary immune deficiencies, HW disease, CLL, recurrent bronchitis, sinusitis, otitis media, conjunctivitis, pneumonia, hepatitis, meningitis, herpes zoster (e.g., severe herpes zoster), and/or pneumocystis carnii. Other diseases and disorders that may be prevented, diagnosed, prognosed, and/or treated with polynucleotides or polypeptides, and/or agonists of the present invention include, but are not limited to, HIV infection, HTLV-BLV infection, lymphopenia, phagocyte bactericidal dysfunction anemia, thrombocytopenia, and hemoglobinuria.

In another embodiment, polynucleotides, polypeptides, antibodies, and/or agonists or antagonists of the present invention are used to treat, and/or diagnose an individual having common variable immunodeficiency disease ("CVID"; also known as "acquired agammaglobulinemia" and "acquired hypogammaglobulinemia") or a subset of this disease.

In a specific embodiment, polynucleotides, polypeptides, antibodies, and/or agonists or antagonists of the present invention may be used to diagnose, prognose, prevent, and/or treat cancers or neoplasms including immune cell or immune tissue-related cancers or neoplasms. Examples of cancers or neoplasms that may be prevented, diagnosed, or treated by polynucleotides, polypeptides, antibodies, and/or agonists or antagonists of the present invention include, but are not limited to, acute myelogenous leukemia, chronic myelogenous leukemia, Hodgkin's disease, non-Hodgkin's lymphoma, acute lymphocytic anemia (ALL) Chronic lymphocyte leukemia, plasmacytomas, multiple myeloma, Burkitt's lymphoma, EBV-transformed diseases, and/or diseases and disorders described in the section entitled "Hyperproliferative Disorders" elsewhere herein.

In another specific embodiment, polypeptides, antibodies, polynucleotides and/or agonists or antagonists of the present invention are used as a therapy for decreasing cellular proliferation of Large B-cell Lymphomas.

In another specific embodiment, polypeptides, antibodies, polynucleotides and/or agonists or antagonists of the present invention are used as a means of decreasing the involvement of B cells and Ig associated with Chronic Myelogenous Leukemia.

In specific embodiments, the compositions of the invention are used as an agent to boost immunoresponsiveness among B cell immunodeficient individuals, such as, for example, an individual who has undergone a partial or complete splenectomy.

Antagonists of the invention include, for example, binding and/or inhibitory antibodies, antisense nucleic acids, ribozymes or soluble forms of the polypeptides of the present invention (e.g., Fc fusion protein; see, e.g., Example 9). Agonists of the invention include, for example, binding or stimulatory antibodies, and soluble forms of the polypeptides (e.g., Fc fusion proteins; see, e.g., Example 9). polypeptides, antibodies, polynucleotides and/or agonists or antagonists of the present invention may be employed in a composition with a pharmaceutically acceptable carrier, e.g., as described herein.

In another embodiment, polypeptides, antibodies, polynucleotides and/or agonists or antagonists of the present invention are administered to an animal (including, but not limited to, those listed above, and also including transgenic animals) incapable of producing functional endogenous antibody molecules or having an otherwise compromised endogenous immune system, but which is capable of producing human immunoglobulin molecules by means of a reconstituted or partially reconstituted immune system from another animal (see, e.g., published PCT Application Nos. WO98/24893, WO/9634096, WO/9633735, and WO/9110741). Administration of polypeptides, antibodies, polynucleotides and/or agonists or antagonists of the present invention to such animals is useful for the generation of monoclonal antibodies against the polypeptides, antibodies, polynucleotides and/or agonists or antagonists of the present invention in an organ system listed above.

Blood-Related Disorders

The polynucleotides, polypeptides, antibodies, and/or agonists or antagonists of the present invention may be used to modulate hemostatic (the stopping of bleeding) or thrombolytic (clot dissolving) activity. For example, by increasing hemostatic or thrombolytic activity, polynucleotides or polypeptides, and/or agonists or antagonists of the present invention could be used to treat or prevent blood coagulation diseases, disorders, and/or conditions (e.g., afibrinogenemia, factor deficiencies, hemophilia), blood platelet diseases, disorders, and/or conditions (e.g., thrombocytopenia), or wounds resulting from trauma, surgery, or other causes. Alternatively, polynucleotides, polypeptides, antibodies, and/or agonists or antagonists of the present invention that can decrease hemostatic or thrombolytic activity could be used to inhibit or dissolve clotting. These molecules could be important in the treatment or prevention of heart attacks (infarction), strokes, or scarring.

In specific embodiments, the polynucleotides, polypeptides, antibodies, and/or agonists or antagonists of the present invention may be used to prevent, diagnose, prognose, and/or treat thrombosis, arterial thrombosis, venous thrombosis, thromboembolism, pulmonary embolism, atherosclerosis, myocardial infarction, transient ischemic attack, unstable angina. In specific embodiments, the polynucleotides, polypeptides, antibodies, and/or agonists or antagonists of the present invention may be used for the prevention of occlusion of saphenous grafts, for reducing the risk of periprocedural thrombosis as might accompany angioplasty procedures, for reducing the risk of stroke in patients with atrial fibrillation including nonrheumatic atrial fibrillation, for reducing the risk of embolism associated with mechanical heart valves and or mitral valves disease. Other uses for the polynucleotides, polypeptides, antibodies, and/or agonists or antagonists of the present invention, include, but are not limited to, the prevention of occlusions in extrcorporeal devices (e.g., intravascular canulas, vascular access shunts in hemodialysis patients, hemodialysis machines, and cardiopulmonary bypass machines).

In another embodiment, a polypeptide of the invention, or polynucleotides, antibodies, agonists, or antagonists corresponding to that polypeptide, may be used to prevent, diagnose, prognose, and/or treat diseases and disorders of the blood and/or blood forming organs associated with the tissue(s) in which the polypeptide of the invention is expressed, including one, two, three, four, five, or more tissues disclosed in Table 1A, column 8 (Tissue Distribution Library Code).

The polynucleotides, polypeptides, antibodies, and/or agonists or antagonists of the present invention may be used to modulate hematopoietic activity (the formation of blood cells). For example, the polynucleotides, polypeptides, antibodies, and/or agonists or antagonists of the present invention may be used to increase the quantity of all or subsets of blood cells, such as, for example, erythrocytes, lymphocytes (B or T cells), myeloid cells (e.g., basophils, eosinophils, neutrophils, mast cells, macrophages) and platelets. The ability to decrease the quantity of blood cells or subsets of blood cells may be useful in the prevention, detection, diagnosis and/or treatment of anemias and leukopenias described below. Alternatively, the polynucleotides, polypeptides, antibodies, and/ or agonists or antagonists of the present invention may be used to decrease the quantity of all or subsets of blood cells, such as, for example, erythrocytes, lymphocytes (B or T cells), myeloid cells (e.g., basophils, eosinophils, neutrophils, mast cells, macrophages) and platelets. The ability to decrease the quantity of blood cells or subsets of blood cells may be useful in the prevention, detection, diagnosis and/or treatment of leukocytoses, such as, for example eosinophilia.

The polynucleotides, polypeptides, antibodies, and/or agonists or antagonists of the present invention may be used to prevent, treat, or diagnose blood dyscrasia.

Anemias are conditions in which the number of red blood cells or amount of hemoglobin (the protein that carries oxygen) in them is below normal. Anemia may be caused by excessive bleeding, decreased red blood cell production, or increased red blood cell destruction (hemolysis). The polynucleotides, polypeptides, antibodies, and/or agonists or antagonists of the present invention may be useful in treating, preventing, and/or diagnosing anemias. Anemias that may be treated prevented or diagnosed by the polynucleotides, polypeptides, antibodies, and/or agonists or antagonists of the present invention include iron deficiency anemia, hypochromic anemia, microcytic anemia, chlorosis, hereditary siderob;astic anemia, idiopathic acquired sideroblastic anemia, red cell aplasia, megaloblastic anemia (e.g., pernicious anemia, (vitamin B12 deficiency) and folic acid deficiency anemia), aplastic anemia, hemolytic anemias (e.g., autoimmune helolytic anemia, microangiopathic hemolytic anemia, and paroxysmal nocturnal hemoglobinuria). The polynucleotides, polypeptides, antibodies, and/or agonists or antagonists of the present invention may be useful in treating, preventing, and/or diagnosing anemias associated with diseases including but not limited to, anemias associated with systemic lupus erythematosus, cancers, lymphomas, chronic renal disease, and enlarged spleens. The polynucleotides, polypeptides, antibodies, and/or agonists or antagonists of the present invention may be useful in treating, preventing, and/or diagnosing anemias arising from drug treatments such as anemias associated with methyldopa, dapsone, and/or sulfa-drugs. Additionally, rhe polynucleotides, polypeptides, antibodies, and/or agonists or antagonists of the present invention may be useful in treating, preventing, and/or diagnosing anemias associated with abnormal red blood cell architecture including but not limited to, hereditary spherocytosis, hereditary elliptocytosis, glucose-6-phosphate dehydrogenase deficiency, and sickle cell anemia.

The polynucleotides, polypeptides, antibodies, and/or agonists or antagonists of the present invention may be useful in treating, preventing, and/or diagnosing hemoglobin abnormalities, (e.g., those associated with sickle cell anemia, hemoglobin C disease, hemoglobin S—C disease, and hemoglobin E disease). Additionally, the polynucleotides, polypeptides, antibodies, and/or agonists or antagonists of the present invention may be useful in diagnosing, prognosing, preventing, and/or treating thalassemias, including, but not limited to major and minor forms of alpha-thalassemia and beta-thalassemia.

In another embodiment, the polynucleotides, polypeptides, antibodies, and/or agonists or antagonists of the present invention may be useful in diagnosing, prognosing, preventing, and/or treating bleeding disorders including, but not limited to, thrombocytopenia (e.g., idiopathic thrombocytopenic purpura, and thrombotic thrombocytopenic purpura), Von Willebrand's disease, hereditary platelet disorders (e.g., storage pool disease such as Chediak-Higashi and Hermansky-Pudlak syndromes, thromboxane A2 dysfunction, thrombo-asthenia, and Bernard-Soulier syndrome), hemolytic-uremic syndrome, hemophelias such as hemophelia A or Factor VII deficiency and Christmas disease or Factor IX deficiency, Hereditary Hemorhhagic Telangiectsia, also known as Rendu-Osler-Weber syndrome, allergic purpura (Henoch Schonlein purpura) and disseminated intravascular coagulation.

The effect of the polynucleotides, polypeptides, antibodies, and/or agonists or antagonists of the present invention on the clotting time of blood may be monitored using any of the clotting tests known in the art including, but not limited to, whole blood partial thromboplastin time (PTT), the activated partial thromboplastin time (aPTT), the activated clotting time (ACT), the recalcified activated clotting time, or the Lee-White Clotting time.

Several diseases and a variety of drugs can cause platelet dysfunction. Thus, in a specific embodiment, the polynucleotides, polypeptides, antibodies, and/or agonists or antagonists of the present invention may be useful in diagnosing, prognosing, preventing, and/or treating acquired platelet dysfunction such as platelet dysfunction accompanying kidney failure, leukemia, multiple myeloma, cirrhosis of the liver, and systemic lupus erythematosus as well as platelet dysfunction associated with drug treatments, including treatment with aspirin, ticlopidine, nonsteroidal anti-inflammatory drugs (used for arthritis, pain, and sprains), and penicillin in high doses.

In another embodiment, the polynucleotides, polypeptides, antibodies, and/or agonists or antagonists of the present invention may be useful in diagnosing, prognosing, preventing, and/or treating diseases and disorders characterized by or associated with increased or decreased numbers of white blood cells. Leukopenia occurs when the number of white blood cells decreases below normal. Leukopenias include, but are not limited to, neutropenia and lymphocytopenia. An increase in the number of white blood cells compared to normal is known as leukocytosis. The body generates increased numbers of white blood cells during infection. Thus, leukocytosis may simply be a normal physiological parameter that reflects infection. Alternatively, leukocytosis may be an indicator of injury or other disease such as cancer. Leokocytoses, include but are not limited to, eosinophilia, and accumulations of macrophages. In specific embodiments, the polynucleotides, polypeptides, antibodies, and/or agonists or antagonists of the present invention may be useful in diagnosing, prognosing, preventing, and/or treating leukopenia. In other specific embodiments, the polynucleotides, polypeptides, antibodies, and/or agonists or antagonists of the present invention may be useful in diagnosing, prognosing, preventing, and/or treating leukocytosis.

Leukopenia may be a generalized decreased in all types of white blood cells, or may be a specific depletion of particular types of white blood cells. Thus, in specific embodiments, the polynucleotides, polypeptides, antibodies, and/or agonists or antagonists of the present invention may be useful in diagnosing, prognosing, preventing, and/or treating decreases in neutrophil numbers, known as neutropenia. Neutropenias that may be diagnosed, prognosed, prevented, and/or treated by the polynucleotides, polypeptides, antibodies, and/or agonists or antagonists of the present invention include, but are not limited to, infantile genetic agranulocytosis, familial neutropenia, cyclic neutropenia, neutropenias resulting from or associated with dietary deficiencies (e.g., vitamin B 12 deficiency or folic acid deficiency), neutropenias resulting from or associated with drug treatments (e.g., antibiotic regimens such as penicillin treatment, sulfonamide treatment, anticoagulant treatment, anticonvulsant drugs, anti-thyroid drugs, and cancer chemotherapy), and neutropenias resulting from increased neutrophil destruction that may occur in association with some bacterial or viral infections, allergic disorders, autoimmune diseases, conditions in which an individual has an enlarged spleen (e.g., Felty syndrome, malaria and sarcoidosis), and some drug treatment regimens.

The polynucleotides, polypeptides, antibodies, and/or agonists or antagonists of the present invention may be useful in diagnosing, prognosing, preventing, and/or treating lymphocytopenias (decreased numbers of B and/or T lymphocytes), including, but not limited lymphocytopenias resulting from or associated with stress, drug treatments (e.g., drug treatment with corticosteroids, cancer chemotherapies, and/or radiation therapies), AIDS infection and/or other diseases such as, for example, cancer, rheumatoid arthritis, systemic lupus erythematosus, chronic infections, some viral infections and/or hereditary disorders (e.g., DiGeorge syndrome, Wiskott-Aldrich Syndome, severe combined immunodeficiency, ataxia telangiectsia).

The polynucleotides, polypeptides, antibodies, and/or agonists or antagonists of the present invention may be useful in diagnosing, prognosing, preventing, and/or treating diseases and disorders associated with macrophage numbers and/or macrophage function including, but not limited to, Gaucher's disease, Niemann-Pick disease, Letterer-Siwe disease and Hand-Schuller-Christian disease.

In another embodiment, the polynucleotides, polypeptides, antibodies, and/or agonists or antagonists of the present invention may be useful in diagnosing, prognosing, preventing, and/or treating diseases and disorders associated with eosinophil numbers and/or eosinophil function including, but not limited to, idiopathic hypereosinophilic syndrome, eosinophilia-myalgia syndrome, and Hand-Schuller-Christian disease.

In yet another embodiment, the polynucleotides, polypeptides, antibodies, and/or agonists or antagonists of the present invention may be useful in diagnosing, prognosing, preventing, and/or treating leukemias and lymphomas including, but not limited to, acute lymphocytic (lymphpblastic) leukemia (ALL), acute myeloid (myelocytic, myelogenous, myeloblastic, or myelomonocytic) leukemia, chronic lymphocytic leukemia (e.g., B cell leukemias, T cell leukemias, Sezary syndrome, and Hairy cell leukenia), chronic myelocytic (myeloid, myelogenous, or granulocytic) leukemia, Hodgkin's lymphoma, non-hodgkin's lymphoma, Burkitt's lymphoma, and mycosis fungoides.

In other embodiments, the polynucleotides, polypeptides, antibodies, and/or agonists or antagonists of the present invention may be useful in diagnosing, prognosing, preventing, and/or treating diseases and disorders of plasma cells including, but not limited to, plasma cell dyscrasias, monoclonal gammaopathies, monoclonal gammopathies of undetermined significance, multiple myeloma, macroglobulinemia, Waldenstrom's macroglobulinemia, cryoglobulinemia, and Raynaud's phenomenon.

In other embodiments, the polynucleotides, polypeptides, antibodies, and/or agonists or antagonists of the present invention may be useful in treating, preventing, and/or diagnosing myeloproliferative disorders, including but not limited to, polycythemia vera, relative polycythemia, secondary polycythemia, myelofibrosis, acute myelofibrosis, agnogenic myelod metaplasia, thrombocythemia, (including both primary and seconday thrombocythemia) and chronic myelocytic leukemia.

In other embodiments, the polynucleotides, polypeptides, antibodies, and/or agonists or antagonists of the present invention may be useful as a treatment prior to surgery, to increase blood cell production.

In other embodiments, the polynucleotides, polypeptides, antibodies, and/or agonists or antagonists of the present invention may be useful as an agent to enhance the migration, phagocytosis, superoxide production, antibody dependent cellular cytotoxicity of neutrophils, eosionophils and macrophages.

In other embodiments, the polynucleotides, polypeptides, antibodies, and/or agonists or antagonists of the present invention may be useful as an agent to increase the number of stem cells in circulation prior to stem cells pheresis. In another specific embodiment, the polynucleotides, polypeptides, antibodies, and/or agonists or antagonists of the present invention may be useful as an agent to increase the number of stem cells in circulation prior to platelet pheresis.

In other embodiments, the polynucleotides, polypeptides, antibodies, and/or agonists or antagonists of the present invention may be useful as an agent to increase cytokine production.

In other embodiments, the polynucleotides, polypeptides, antibodies, and/or agonists or antagonists of the present invention may be useful in preventing, diagnosing, and/or treating primary hematopoietic disorders.

Hyperproliferative Disorders

In certain embodiments, polynucleotides or polypeptides, or agonists or antagonists of the present invention can be used to treat or detect hyperproliferative disorders, including neoplasms. Polynucleotides or polypeptides, or agonists or antagonists of the present invention may inhibit the proliferation of the disorder through direct or indirect interactions. Alternatively, Polynucleotides or polypeptides, or agonists or antagonists of the present invention may proliferate other cells which can inhibit the hyperproliferative disorder.

For example, by increasing an immune response, particularly increasing antigenic qualities of the hyperproliferative disorder or by proliferating, differentiating, or mobilizing T-cells, hyperproliferative disorders can be treated. This immune response may be increased by either enhancing an existing immune response, or by initiating a new immune response. Alternatively, decreasing an immune response may also be a method of treating hyperproliferative disorders, such as a chemotherapeutic agent.

Examples of hyperproliferative disorders that can be treated or detected by polynucleotides or polypeptides, or agonists or antagonists of the present invention include, but are not limited to neoplasms located in the: colon, abdomen, bone, breast, digestive system, liver, pancreas, peritoneum, endocrine glands (adrenal, parathyroid, pituitary, testicles, ovary, thymus, thyroid), eye, head and neck, nervous (central and peripheral), lymphatic system, pelvis, skin, soft tissue, spleen, thorax, and urogenital tract.

Similarly, other hyperproliferative disorders can also be treated or detected by polynucleotides or polypeptides, or agonists or antagonists of the present invention. Examples of such hyperproliferative disorders include, but are not limited to: Acute Childhood Lymphoblastic Leukemia, Acute Lymphoblastic Leukemia, Acute Lymphocytic Leukemia, Acute Myeloid Leukemia, Adrenocortical Carcinoma, Adult (Primary) Hepatocellular Cancer, Adult (Primary) Liver Cancer, Adult Acute Lymphocytic Leukemia, Adult Acute Myeloid Leukemia, Adult Hodgkin's Disease, Adult Hodgkin's Lymphoma, Adult Lymphocytic Leukemia, Adult Non-Hodgkin's Lymphoma, Adult Primary Liver Cancer, Adult Soft Tissue Sarcoma, AIDS-Related Lymphoma, AIDS-Related Malignancies, Anal Cancer, Astrocytoma, Bile Duct Cancer, Bladder Cancer, Bone Cancer, Brain Stem Glioma, Brain Tumors, Breast Cancer, Cancer of the Renal Pelvis and Ureter, Central Nervous System (Primary) Lymphoma, Central Nervous System Lymphoma, Cerebellar Astrocytoma, Cerebral Astrocytoma, Cervical Cancer, Childhood (Primary) Hepatocellular Cancer, Childhood (Primary) Liver Cancer, Childhood Acute Lymphoblastic Leukemia, Childhood Acute Myeloid Leukemia, Childhood Brain Stem Glioma, Childhood Cerebellar Astrocytoma, Childhood Cerebral Astrocytoma, Childhood Extracranial Germ Cell Tumors, Childhood Hodgkin's Disease, Childhood Hodgkin's Lymphoma, Childhood Hypothalamic and Visual Pathway Glioma, Childhood Lymphoblastic Leukemia, Childhood Medulloblastoma, Childhood Non-Hodgkin's Lymphoma, Childhood Pineal and Supratentorial Primitive Neuroectodermal Tumors, Childhood Primary Liver Cancer, Childhood Rhabdomyosarcoma, Childhood Soft Tissue Sarcoma, Childhood Visual Pathway and Hypothalamic Glioma, Chronic Lymphocytic Leukemia, Chronic Myelogenous Leukemia, Colon Cancer, Cutaneous T-Cell Lymphoma, Endocrine Pancreas Islet Cell Carcinoma, Endometrial Cancer, Ependymoma, Epithelial Cancer, Esophageal Cancer, Ewing's Sarcoma and Related Tumors, Exocrine Pancreatic Cancer, Extracranial Germ Cell Tumor, Extragonadal Germ Cell Tumor, Extrahepatic Bile Duct Cancer, Eye Cancer, Female Breast Cancer, Gaucher's Disease, Gallbladder Cancer, Gastric Cancer, Gastrointestinal Carcinoid Tumor, Gastrointestinal Tumors, Germ Cell Tumors, Gestational Trophoblastic Tumor, Hairy Cell Leukemia, Head and Neck Cancer, Hepatocellular Cancer, Hodgkin's Disease, Hodgkin's Lymphoma, Hypergammaglobulinemia, Hypopharyngeal Cancer, Intestinal Cancers, Intraocular Melanoma, Islet Cell Carcinoma, Islet Cell Pancreatic Cancer, Kaposi's Sarcoma, Kidney Cancer, Laryngeal Cancer, Lip and Oral Cavity Cancer, Liver Cancer, Lung Cancer, Lymphoproliferative Disorders, Macroglobulinemia, Male Breast Cancer, Malignant Mesothelioma, Malignant Thymoma, Medulloblastoma, Melanoma, Mesothelioma, Metastatic Occult Primary Squamous Neck Cancer, Metastatic Primary Squamous Neck Cancer, Metastatic Squamous Neck Cancer, Multiple Myeloma, Multiple Myeloma/Plasma Cell Neoplasm, Myelodysplastic Syndrome, Myelogenous Leukemia, Myeloid Leukemia, Myeloproliferative Disorders, Nasal Cavity and Paranasal Sinus Cancer, Nasopharyngeal Cancer, Neuroblastoma, Non-Hodgkin's Lymphoma During Pregnancy, Nonmelanoma Skin Cancer, Non-Small Cell Lung Cancer, Occult Primary Metastatic Squamous Neck Cancer, Oropharyngeal Cancer, Osteo-/Malignant Fibrous Sarcoma, Osteosarcoma/Malignant Fibrous Histiocytoma, Osteosarcoma/Malignant Fibrous Histiocytoma of Bone, Ovarian Epithelial Cancer, Ovarian Germ Cell Tumor, Ovarian Low Malignant Potential Tumor, Pancreatic Cancer, Paraproteinemias, Purpura, Parathyroid Cancer, Penile Cancer, Pheochromocytoma, Pituitary Tumor, Plasma Cell Neoplasm/Multiple Myeloma, Primary Central Nervous System Lymphoma, Primary Liver Cancer, Prostate Cancer, Rectal Cancer, Renal Cell Cancer, Renal Pelvis and Ureter Cancer, Retinoblastoma, Rhabdomyosarcoma, Salivary Gland Cancer, Sarcoidosis Sarcomas, Sezary Syndrome, Skin Cancer, Small Cell Lung Cancer, Small Intestine Cancer, Soft Tissue Sarcoma, Squamous Neck Cancer, Stomach Cancer, Supratentorial Primitive Neuroectodermal and Pineal Tumors, T-Cell Lymphoma, Testicular Cancer, Thymoma, Thyroid Cancer, Transitional Cell Cancer of the Renal Pelvis and Ureter, Transitional Renal Pelvis and Ureter Cancer, Trophoblastic Tumors, Ureter and Renal Pelvis Cell Cancer, Urethral Cancer, Uterine Cancer, Uterine Sarcoma, Vaginal Cancer, Visual Pathway and Hypothalamic Glioma, Vulvar Cancer, Waldenstrom's Macroglobulinemia, Wilms' Tumor, and any other hyperproliferative disease, besides neoplasia, located in an organ system listed above.

In another preferred embodiment, polynucleotides or polypeptides, or agonists or antagonists of the present invention are used to diagnose, prognose, prevent, and/or treat premalignant conditions and to prevent progression to a neoplastic or malignant state, including but not limited to those disorders described above. Such uses are indicated in conditions known or suspected of preceding progression to neoplasia or cancer, in particular, where non-neoplastic cell growth consisting of hyperplasia, metaplasia, or most particularly, dysplasia has occurred (for review of such abnormal growth conditions, see Robbins and Angell, 1976, Basic Pathology, 2d Ed., W. B. Saunders Co., Philadelphia, pp. 68-79.)

Hyperplasia is a form of controlled cell proliferation, involving an increase in cell number in a tissue or organ, without significant alteration in structure or function. Hyperplastic disorders which can be diagnosed, prognosed, prevented, and/or treated with compositions of the invention (including polynucleotides, polypeptides, agonists or antagonists) include, but are not limited to, angiofollicular mediastinal lymph node hyperplasia, angiolymphoid hyperplasia with eosinophilia, atypical melanocytic hyperplasia, basal cell hyperplasia, benign giant lymph node hyperplasia, cementum hyperplasia, congenital adrenal hyperplasia, congenital sebaceous hyperplasia, cystic hyperplasia, cystic hyperplasia of the breast, denture hyperplasia, ductal hyperplasia, endometrial hyperplasia, fibromuscular hyperplasia, focal epithelial hyperplasia, gingival hyperplasia, inflammatory fibrous hyperplasia, inflammatory papillary hyperplasia, intravascular papillary endothelial hyperplasia, nodular hyperplasia of prostate, nodular regenerative hyperplasia, pseudoepitheliomatous hyperplasia, senile sebaceous hyperplasia, and verrucous hyperplasia.

Metaplasia is a form of controlled cell growth in which one type of adult or fully differentiated cell substitutes for another type of adult cell. Metaplastic disorders which can be diagnosed, prognosed, prevented, and/or treated with compositions of the invention (including polynucleotides, polypeptides, agonists or antagonists) include, but are not limited to, agnogenic myeloid metaplasia, apocrine metaplasia, atypical metaplasia, autoparenchymatous metaplasia, connective tissue metaplasia, epithelial metaplasia, intestinal metaplasia, metaplastic anemia, metaplastic ossification, metaplastic polyps, myeloid metaplasia, primary myeloid metaplasia, secondary myeloid metaplasia, squamous metaplasia, squamous metaplasia of amnion, and symptomatic myeloid metaplasia.

Dysplasia is frequently a forerunner of cancer, and is found mainly in the epithelia; it is the most disorderly form of non-neoplastic cell growth, involving a loss in individual cell uniformity and in the architectural orientation of cells. Dysplastic cells often have abnormally large, deeply stained nuclei, and exhibit pleomorphism. Dysplasia characteristically occurs where there exists chronic irritation or inflammation. Dysplastic disorders which can be diagnosed, prognosed, prevented, and/or treated with compositions of the invention (including polynucleotides, polypeptides, agonists or antagonists) include, but are not limited to, anhidrotic ectodermal dysplasia, anterofacial dysplasia, asphyxiating thoracic dysplasia, atriodigital dysplasia, bronchopulmonary dysplasia, cerebral dysplasia, cervical dysplasia, chondroectodermal dysplasia, cleidocranial dysplasia, congenital ectodermal dysplasia, craniodiaphysial dysplasia, craniocarpotarsal dysplasia, craniometaphysial dysplasia, dentin dysplasia, diaphysial dysplasia, ectodermal dysplasia, enamel dysplasia, encephalo-ophthalmic dysplasia, dysplasia epiphysialis hemimelia, dysplasia epiphysialis multiplex, dysplasia epiphysialis punctata, epithelial dysplasia, faciodigitogenital dysplasia, familial fibrous dysplasia of jaws, familial white folded dysplasia, fibromuscular dysplasia, fibrous dysplasia of bone, florid osseous dysplasia, hereditary renal-retinal dysplasia, hidrotic ectodermal dysplasia, hypohidrotic ectodermal dysplasia, lymphopenic thymic dysplasia, mammary dysplasia, mandibulofacial dysplasia, metaphysial dysplasia, Mondini dysplasia, monostotic fibrous dysplasia, mucoepithelial dysplasia, multiple epiphysial dysplasia, oculoauriculovertebral dysplasia, oculodentodigital dysplasia, oculovertebral dysplasia, odontogenic dysplasia, opthalmomandibulomelic dysplasia, periapical cemental dysplasia, polyostotic fibrous dysplasia, pseudoachondroplastic spondyloepiphysial dysplasia, retinal dysplasia, septo-optic dysplasia, spondyloepiphysial dysplasia, and ventriculoradial dysplasia.

Additional pre-neoplastic disorders which can be diagnosed, prognosed, prevented, and/or treated with compositions of the invention (including polynucleotides, polypeptides, agonists or antagonists) include, but are not limited to, benign dysproliferative disorders (e.g., benign tumors, fibrocystic conditions, tissue hypertrophy, intestinal polyps, colon polyps, and esophageal dysplasia), leukoplakia, keratoses, Bowen's disease, Farmer's Skin, solar cheilitis, and solar keratosis.

In another embodiment, a polypeptide of the invention, or polynucleotides, antibodies, agonists, or antagonists corresponding to that polypeptide, may be used to diagnose and/or prognose disorders associated with the tissue(s) in which the polypeptide of the invention is expressed, including one, two, three, four, five, or more tissues disclosed in Table 1A, column 8 (Tissue Distribution Library Code).

In another embodiment, polynucleotides, polypeptides, antibodies, and/or agonists or antagonists of the present invention conjugated to a toxin or a radioactive isotope, as described herein, may be used to treat cancers and neoplasms, including, but not limited to those described herein. In a further preferred embodiment, polynucleotides, polypeptides, antibodies, and/or agonists or antagonists of the present invention conjugated to a toxin or a radioactive isotope, as described herein, may be used to treat acute myelogenous leukemia.

Additionally, polynucleotides, polypeptides, and/or agonists or antagonists of the invention may affect apoptosis, and therefore, would be useful in treating a number of diseases associated with increased cell survival or the inhibition of apoptosis. For example, diseases associated with increased cell survival or the inhibition of apoptosis that could be diagnosed, prognosed, prevented, and/or treated by polynucleotides, polypeptides, and/or agonists or antagonists of the invention, include cancers (such as follicular lymphomas, carcinomas with p53 mutations, and hormone-dependent tumors, including, but not limited to colon cancer, cardiac tumors, pancreatic cancer, melanoma, retinoblastoma, glioblastoma, lung cancer, intestinal cancer, testicular cancer, stomach cancer, neuroblastoma, myxoma, myoma, lymphoma, endothelioma, osteoblastoma, osteoclastoma, osteosarcoma, chondrosarcoma, adenoma, breast cancer, prostate cancer, Kaposi's sarcoma and ovarian cancer); autoimmune disorders such as, multiple sclerosis, Sjogren's syndrome, Hashimoto's thyroiditis, biliary cirrhosis, Behcet's disease, Crohn's disease, polymyositis, systemic lupus erythematosus and immune-related glomerulonephritis and rheumatoid arthritis) and viral infections (such as herpes viruses, pox viruses and adenoviruses), inflammation, graft v. host disease, acute graft rejection, and chronic graft rejection.

In preferred embodiments, polynucleotides, polypeptides, and/or agonists or antagonists of the invention are used to inhibit growth, progression, and/or metastasis of cancers, in particular those listed above.

Additional diseases or conditions associated with increased cell survival that could be diagnosed, prognosed, prevented, and/or treated by polynucleotides, polypeptides, and/or agonists or antagonists of the invention, include, but are not limited to, progression, and/or metastases of malignancies and related disorders such as leukemia (including acute leukemias (e.g., acute lymphocytic leukemia, acute myelocytic leukemia (including myeloblastic, promyelocytic, myelomonocytic, monocytic, and erythroleukemia)) and chronic leukemias (e.g., chronic myelocytic (granulocytic) leukemia and chronic lymphocytic leukemia)), polycythemia vera, lymphomas (e.g., Hodgkin's disease and non-Hodgkin's disease), multiple myeloma, Waldenstrom's macroglobulinemia, heavy chain disease, and solid tumors including, but not limited to, sarcomas and carcinomas such as fibrosarcoma, myxosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, Ewing's tumor, leiomyosarcoma, rhabdomyosarcoma, colon carcinoma, pancreatic cancer, breast cancer, ovarian cancer, prostate cancer, squamous cell carcinoma, basal cell carcinoma, adenocarcinoma, sweat gland carcinoma, sebaceous gland carcinoma, papillary carcinoma, papillary adenocarcinomas, cystadenocarcinoma, medullary carcinoma, bronchogenic carcinoma, renal cell carcinoma, hepatoma, bile duct carcinoma, choriocarcinoma, seminoma, embryonal carcinoma, Wilm's tumor, cervical cancer, testicular tumor, lung carcinoma, small cell lung carcinoma, bladder carcinoma, epithelial carcinoma, glioma, astrocytoma, medulloblastoma, craniopharyngioma, ependymoma, pinealoma, emangioblastoma, acoustic neuroma, oligodendroglioma, menangioma, melanoma, neuroblastoma, and retinoblastoma.

Diseases associated with increased apoptosis that could be diagnosed, prognosed, prevented, and/or treated by polynucleotides, polypeptides, and/or agonists or antagonists of the invention, include AIDS; neurodegenerative disorders (such as Alzheimer's disease, Parkinson's disease, amyotrophic lateral sclerosis, retinitis pigmentosa, cerebellar degeneration and brain tumor or prior associated disease); autoimmune disorders (such as, multiple sclerosis, Sjogren's syndrome, Hashimoto's thyroiditis, biliary cirrhosis, Behcet's disease, Crohn's disease, polymyositis, systemic lupus erythematosus and immune-related glomerulonephritis and rheumatoid arthritis) myelodysplastic syndromes (such as aplastic anemia), graft v. host disease, ischemic injury (such as that caused by myocardial infarction, stroke and reperfusion injury), liver injury (e.g., hepatitis related liver injury, ischemia/reperfusion injury, cholestosis (bile duct injury) and liver cancer); toxin-induced liver disease (such as that caused by alcohol), septic shock, cachexia and anorexia.

Hyperproliferative diseases and/or disorders that could be diagnosed, prognosed, prevented, and/or treated by polynucleotides, polypeptides, and/or agonists or antagonists of the invention, include, but are not limited to, neoplasms located in the liver, abdomen, bone, breast, digestive system, pancreas, peritoneum, endocrine glands (adrenal, parathyroid, pituitary, testicles, ovary, thymus, thyroid), eye, head and neck, nervous system (central and peripheral), lymphatic system, pelvis, skin, soft tissue, spleen, thorax, and urogenital tract.

Similarly, other hyperproliferative disorders can also be diagnosed, prognosed, prevented, and/or treated by polynucleotides, polypeptides, and/or agonists or antagonists of the invention. Examples of such hyperproliferative disorders include, but are not limited to: hypergammaglobulinemia, lymphoproliferative disorders, paraproteinemias, purpura, sarcoidosis, Sezary Syndrome, Waldenstron's macroglobulinemia, Gaucher's Disease, histiocytosis, and any other hyperproliferative disease, besides neoplasia, located in an organ system listed above.

Another preferred embodiment utilizes polynucleotides of the present invention to inhibit aberrant cellular division, by gene therapy using the present invention, and/or protein fusions or fragments thereof.

Thus, the present invention provides a method for treating cell proliferative disorders by inserting into an abnormally proliferating cell a polynucleotide of the present invention, wherein said polynucleotide represses said expression.

Another embodiment of the present invention provides a method of treating cell-proliferative disorders in individuals comprising administration of one or more active gene copies of the present invention to an abnormally proliferating cell or cells. In a preferred embodiment, polynucleotides of the present invention is a DNA construct comprising a recombinant expression vector effective in expressing a DNA sequence encoding said polynucleotides.

In another preferred embodiment of the present invention, the DNA construct encoding the polynucleotides of the present invention is inserted into cells to be treated utilizing a retrovirus, or more preferably an adenoviral vector (See G J. Nabel, et. al., PNAS 1999 96: 324-326, which is hereby incorporated by reference). In a most preferred embodiment, the viral vector is defective and will not transform non-proliferating cells, only proliferating cells. Moreover, in a preferred embodiment, the polynucleotides of the present invention inserted into proliferating cells either alone, or in combination with or fused to other polynucleotides, can then be modulated via an external stimulus (i.e. magnetic, specific small molecule, chemical, or drug administration, etc.), which acts upon the promoter upstream of said polynucleotides to induce expression of the encoded protein product. As such the beneficial therapeutic affect of the present invention may be expressly modulated (i.e. to increase, decrease, or inhibit expression of the present invention) based upon said external stimulus.

Polynucleotides of the present invention may be useful in repressing expression of oncogenic genes or antigens. By "repressing expression of the oncogenic genes" is intended the suppression of the transcription of the gene, the degradation of the gene transcript (pre-message RNA), the inhibition of splicing, the destruction of the messenger RNA, the prevention of the post-translational modifications of the protein, the destruction of the protein, or the inhibition of the normal function of the protein.

For local administration to abnormally proliferating cells, polynucleotides of the present invention may be administered by any method known to those of skill in the art including, but not limited to transfection, electroporation, microinjection of cells, or in vehicles such as liposomes, lipofectin, or as naked polynucleotides, or any other method described throughout the specification. The polynucleotide of the present invention may be delivered by known gene delivery systems such as, but not limited to, retroviral vectors (Gilboa, J. Virology 44:845 (1982); Hocke, Nature 320:275 (1986); Wilson, et al., Proc. Natl. Acad. Sci. U.S.A. 85:3014), vaccinia virus system (Chakrabarty et al., Mol. Cell Biol. 5:3403 (1985) or other efficient DNA delivery systems (Yates et al., Nature 313:812 (1985)) known to those skilled in the art. These references are exemplary only and are hereby incorporated by reference. In order to specifically deliver or transfect cells which are abnormally proliferating and spare non-dividing cells, it is preferable to utilize a retrovirus, or adenoviral (as described in the art and elsewhere herein) delivery system known to those of skill in the art. Since host DNA replication is required for retroviral DNA to integrate and the retrovirus will be unable to self replicate due to the lack of the retrovirus genes needed for its life cycle. Utilizing such a retroviral delivery system for polynucleotides of the present invention will target said gene and constructs to abnormally proliferating cells and will spare the non-dividing normal cells.

The polynucleotides of the present invention may be delivered directly to cell proliferative disorder/disease sites in internal organs, body cavities and the like by use of imaging devices used to guide an injecting needle directly to the disease site. The polynucleotides of the present invention may also be administered to disease sites at the time of surgical intervention.

By "cell proliferative disease" is meant any human or animal disease or disorder, affecting any one or any combination of organs, cavities, or body parts, which is characterized by single or multiple local abnormal proliferations of cells, groups of cells, or tissues, whether benign or malignant.

Any amount of the polynucleotides of the present invention may be administered as long as it has a biologically inhibiting effect on the proliferation of the treated cells. Moreover, it is possible to administer more than one of the polynucleotide of the present invention simultaneously to the same site. By "biologically inhibiting" is meant partial or total growth inhibition as well as decreases in the rate of proliferation or growth of the cells. The biologically inhibitory dose may be determined by assessing the effects of the polynucleotides of the present invention on target malignant or abnormally proliferating cell growth in tissue culture, tumor growth in animals and cell cultures, or any other method known to one of ordinary skill in the art.

The present invention is further directed to antibody-based therapies which involve administering of anti-polypeptides and anti-polynucleotide antibodies to a mammalian, preferably human, patient for treating one or more of the described disorders. Methods for producing anti-polypeptides and anti-polynucleotide antibodies polyclonal and monoclonal antibodies are described in detail elsewhere herein. Such antibodies may be provided in pharmaceutically acceptable compositions as known in the art or as described herein.

A summary of the ways in which the antibodies of the present invention may be used therapeutically includes binding polynucleotides or polypeptides of the present invention locally or systemically in the body or by direct cytotoxicity of the antibody, e.g. as mediated by complement (CDC) or by effector cells (ADCC). Some of these approaches are described in more detail below. Armed with the teachings provided herein, one of ordinary skill in the art will know how to use the antibodies of the present invention for diagnostic, monitoring or therapeutic purposes without undue experimentation.

In particular, the antibodies, fragments and derivatives of the present invention are useful for treating a subject having or developing cell proliferative and/or differentiation disorders as described herein. Such treatment comprises administering a single or multiple doses of the antibody, or a fragment, derivative, or a conjugate thereof.

The antibodies of this invention may be advantageously utilized in combination with other monoclonal or chimeric antibodies, or with lymphokines or hematopoietic growth factors, for example., which serve to increase the number or activity of effector cells which interact with the antibodies.

It is preferred to use high affinity and/or potent in vivo inhibiting and/or neutralizing antibodies against polypeptides or polynucleotides of the present invention, fragments or regions thereof, for both immunoassays directed to and therapy of disorders related to polynucleotides or polypeptides, including fragements thereof, of the present invention. Such antibodies, fragments, or regions, will preferably have an affinity for polynucleotides or polypeptides, including fragements thereof. Preferred binding affinities include those with a dissociation constant or Kd less than $5 \times 10^{-6}$M, $10^{-6}$M, $5 \times 10^{-7}$M, $10^{-7}$M, $5 \times 10^{-8}$M, $10^{-8}$M, $5 \times 10^{-9}$M, $10^{-9}$M, $5 \times 10^{-10}$M, $10^{-10}$ M, $5 \times 10^{-11}$ M $10^{-11}$ M, $5 \times 10^{-12}$M, $10^{-12}$M, $5 \times 10^{-13}$M, $10^{-13}$M, $5 \times 10^{-14}$M, $10^{-14}$, $5 \times 10^{-15}$M, and $10^{-15}$M.

Moreover, polypeptides of the present invention are useful in inhibiting the angiogenesis of proliferative cells or tissues, either alone, as a protein fusion, or in combination with other polypeptides directly or indirectly, as described elsewhere herein. In a most preferred embodiment, said anti-angiogenesis effect may be achieved indirectly, for example, through the inhibition of hematopoietic, tumor-specific cells, such as tumor-associated macrophages (See Joseph I B, et al. J Natl Cancer Inst, 90(21):1648-53 (1998), which is hereby incorporated by reference). Antibodies directed to polypeptides or polynucleotides of the present invention may also result in inhibition of angiogenesis directly, or indirectly (See Witte L, et al., Cancer Metastasis Rev. 17(2):155-61 (1998), which is hereby incorporated by reference)).

Polypeptides, including protein fusions, of the present invention, or fragments thereof may be useful in inhibiting proliferative cells or tissues through the induction of apoptosis. Said polypeptides may act either directly, or indirectly to induce apoptosis of proliferative cells and tissues, for example in the activation of a death-domain receptor, such as tumor necrosis factor (TNF) receptor-1, CD95 (Fas/APO-1), TNF-receptor-related apoptosis-mediated protein (TRAMP) and TNF-related apoptosis-inducing ligand (TRAIL) receptor-1 and -2 (See Schulze-Osthoff K, et.al., Eur J Biochem 254(3):439-59 (1998), which is hereby incorporated by reference). Moreover, in another preferred embodiment of the present invention, said polypeptides may induce apoptosis through other mechanisms, such as in the activation of other proteins which will activate apoptosis, or through stimulating the expression of said proteins, either alone or in combination with small molecule drugs or adjuviants, such as apoptonin, galectins, thioredoxins, anti-inflammatory proteins (See for example, Mutat Res 400(1-2):447-55 (1998), Med. Hypotheses.50(5):423-33 (1998), Chem Biol Interact. Apr 24; 111-112: 23-34 (1998), J Mol. Med. 76(6):402-12 (1998), Int J Tissue React; 20(1):3-15 (1998), which are all hereby incorporated by reference).

Polypeptides, including protein fusions to, or fragments thereof, of the present invention are useful in inhibiting the metastasis of proliferative cells or tissues Inhibition may occur as a direct result of administering polypeptides, or antibodies directed to said polypeptides as described elsewere herein, or indirectly, such as activating the expression of proteins known to inhibit metastasis, for example alpha 4 integrins, (See, e.g., Curr Top Microbiol Immunol 1998; 231: 125-41, which is hereby incorporated by reference). Such thereapeutic affects of the present invention may be achieved either alone, or in combination with small molecule drugs or adjuvants.

In another embodiment, the invention provides a method of delivering compositions containing the polypeptides of the invention (e.g., compositions containing polypeptides or polypeptide antibodies associated with heterologous polypeptides, heterologous nucleic acids, toxins, or prodrugs) to targeted cells expressing the polypeptide of the present invention. Polypeptides or polypeptide antibodies of the invention may be associated with heterologous polypeptides, heterologous nucleic acids, toxins, or prodrugs via hydrophobic, hydrophilic, ionic and/or covalent interactions.

Polypeptides, protein fusions to, or fragments thereof, of the present invention are useful in enhancing the immunogenicity and/or antigenicity of proliferating cells or tissues, either directly, such as would occur if the polypeptides of the present invention 'vaccinated' the immune response to respond to proliferative antigens and immunogens, or indirectly, such as in activating the expression of proteins known to enhance the immune response (e.g. chemokines), to said antigens and immunogens.

Renal Disorders

Polynucleotides, polypeptides, antibodies, and/or agonists or antagonists of the present invention, may be used to treat, prevent, diagnose, and/or prognose disorders of the renal system. Renal disorders which can be diagnosed, prognosed, prevented, and/or treated with compositions of the invention include, but are not limited to, kidney failure, nephritis, blood vessel disorders of kidney, metabolic and congenital kidney disorders, urinary disorders of the kidney, autoimmune disorders, sclerosis and necrosis, electrolyte imbalance, and kidney cancers.

Kidney diseases which can be diagnosed, prognosed, prevented, and/or treated with compositions of the invention include, but are not limited to, acute kidney failure, chronic kidney failure, atheroembolic renal failure, end-stage renal disease, inflammatory diseases of the kidney (e.g., acute glomerulonephritis, postinfectious glomerulonephritis, rapidly progressive glomerulonephritis, nephrotic syndrome, membranous glomerulonephritis, familial nephrotic syndrome, membranoproliferative glomerulonephritis I and II, mesangial proliferative glomerulonephritis, chronic glomerulonephritis, acute tubulointerstitial nephritis, chronic tubulointerstitial nephritis, acute post-streptococcal glomerulonephritis (PSGN), pyelonephritis, lupus nephritis, chronic nephritis, interstitial nephritis, and post-streptococcal glomerulonephritis), blood vessel disorders of the kidneys (e.g., kidney infarction, atheroembolic kidney disease, cortical necrosis, malignant nephrosclerosis, renal vein thrombosis, renal underperfusion, renal retinopathy, renal ischemia-reperfusion, renal artery embolism, and renal artery stenosis), and kidney disorders resulting form urinary tract disease (e.g., pyelonephritis, hydronephrosis, urolithiasis (renal lithiasis, nephrolithiasis), reflux nephropathy, urinary tract infections, urinary retention, and acute or chronic unilateral obstructive uropathy.)

In addition, compositions of the invention can be used to diagnose, prognose, prevent, and/or treat metabolic and congenital disorders of the kidney (e.g., uremia, renal amyloidosis, renal osteodystrophy, renal tubular acidosis, renal glycosuria, nephrogenic diabetes insipidus, cystinuria, Fanconi's syndrome, renal fibrocystic osteosis (renal rickets), Hartnup disease, Bartter's syndrome, Liddle's syndrome, polycystic kidney disease, medullary cystic disease, medullary sponge kidney, Alport's syndrome, nail-patella syndrome, congenital nephrotic syndrome, CRUSH syndrome, horseshoe kidney, diabetic nephropathy, nephrogenic diabetes insipidus, analgesic nephropathy, kidney stones, and membranous nephropathy), and autoimmune disorders of the kidney (e.g., systemic lupus erythematosus (SLE), Goodpasture syndrome, IgA nephropathy, and IgM mesangial proliferative glomerulonephritis).

Compositions of the invention can also be used to diagnose, prognose, prevent, and/or treat sclerotic or necrotic disorders of the kidney (e.g., glomerulosclerosis, diabetic nephropathy, focal segmental glomerulosclerosis (FSGS), necrotizing glomerulonephritis, and renal papillary necrosis), cancers of the kidney (e.g., nephroma, hypernephroma, nephroblastoma, renal cell cancer, transitional cell cancer, renal adenocarcinoma, squamous cell cancer, and Wilm's tumor), and electrolyte imbalances (e.g., nephrocalcinosis, pyuria, edema, hydronephritis, proteinuria, hyponatremia, hypernatremia, hypokalemia, hyperkalemia, hypocalcemia, hypercalcemia, hypophosphatemia, and hyperphosphatemia).

Polypeptides may be administered using any method known in the art, including, but not limited to, direct needle injection at the delivery site, intravenous injection, topical administration, catheter infusion, biolistic injectors, particle accelerators, gelfoam sponge depots, other commercially available depot materials, osmotic pumps, oral or suppositorial solid pharmaceutical formulations, decanting or topical applications during surgery, aerosol delivery. Such methods are known in the art. Polypeptides may be administered as part of a Therapeutic, described in more detail below. Methods of delivering polynucleotides are described in more detail herein.

Cardiovascular Disorders

Polynucleotides or polypeptides, or agonists or antagonists of the present invention, may be used to treat, prevent, diagnose, and/or prognose cardiovascular disorders, including, but not limited to, peripheral artery disease, such as limb ischemia.

Cardiovascular disorders include, but are not limited to, cardiovascular abnormalities, such as arterio-arterial fistula, arteriovenous fistula, cerebral arteriovenous malformations, congenital heart defects, pulmonary atresia, and Scimitar Syndrome. Congenital heart defects include, but are not limited to, aortic coarctation, cor triatriatum, coronary vessel anomalies, crisscross heart, dextrocardia, patent ductus arteriosus, Ebstein's anomaly, Eisenmenger complex, hypoplastic left heart syndrome, levocardia, tetralogy of fallot, transposition of great vessels, double outlet right ventricle, tricuspid atresia, persistent truncus arteriosus, and heart septal defects, such as aortopulmonary septal defect, endocardial cushion defects, Lutembacher's Syndrome, trilogy of Fallot, ventricular heart septal defects.

Cardiovascular disorders also include, but are not limited to, heart disease, such as arrhythmias, carcinoid heart disease, high cardiac output, low cardiac output, cardiac tamponade, endocarditis (including bacterial), heart aneurysm, cardiac arrest, congestive heart failure, congestive cardiomyopathy, paroxysmal dyspnea, cardiac edema, heart hypertrophy, congestive cardiomyopathy, left ventricular hypertrophy, right ventricular hypertrophy, post-infarction heart rupture, ventricular septal rupture, heart valve diseases, myocardial diseases, myocardial ischemia, pericardial effusion, pericarditis (including constrictive and tuberculous), pneumopericardium, postpericardiotomy syndrome, pulmonary heart disease, rheumatic heart disease, ventricular dysfunction, hyperemia, cardiovascular pregnancy complications, Scimitar Syndrome, cardiovascular syphilis, and cardiovascular tuberculosis.

Arrhythmias include, but are not limited to, sinus arrhythmia, atrial fibrillation, atrial flutter, bradycardia, extrasystole, Adams-Stokes Syndrome, bundle-branch block, sinoatrial block, long QT syndrome, parasystole, Lown-Ganong-Levine Syndrome, Mahaim-type pre-excitation syndrome, Wolff-Parkinson-White syndrome, sick sinus syndrome, tachycardias, and ventricular fibrillation. Tachycardias include paroxysmal tachycardia, supraventricular tachycardia, accelerated idioventricular rhythm, atrioventricular nodal reentry tachycardia, ectopic atrial tachycardia, ectopic junctional tachycardia, sinoatrial nodal reentry tachycardia, sinus tachycardia, Torsades de Pointes, and ventricular tachycardia.

Heart valve diseases include, but are not limited to, aortic valve insufficiency, aortic valve stenosis, hear murmurs, aortic valve prolapse, mitral valve prolapse, tricuspid valve prolapse, mitral valve insufficiency, mitral valve stenosis, pulmonary atresia, pulmonary valve insufficiency, pulmonary valve stenosis, tricuspid atresia, tricuspid valve insufficiency, and tricuspid valve stenosis.

Myocardial diseases include, but are not limited to, alcoholic cardiomyopathy, congestive cardiomyopathy, hypertrophic cardiomyopathy, aortic subvalvular stenosis, pulmonary subvalvular stenosis, restrictive cardiomyopathy, Chagas cardiomyopathy, endocardial fibroelastosis, endomyocardial fibrosis, Kearns Syndrome, myocardial reperfusion injury, and myocarditis.

Myocardial ischemias include, but are not limited to, coronary disease, such as angina pectoris, coronary aneurysm, coronary arteriosclerosis, coronary thrombosis, coronary vasospasm, myocardial infarction and myocardial stunning.

Cardiovascular diseases also include vascular diseases such as aneurysms, angiodysplasia, angiomatosis, bacillary angiomatosis, Hippel-Lindau Disease, Klippel-Trenaunay-Weber Syndrome, Sturge-Weber Syndrome, angioneurotic edema, aortic diseases, Takayasu's Arteritis, aortitis, Leriche's Syndrome, arterial occlusive diseases, arteritis, enarteritis, polyarteritis nodosa, cerebrovascular disorders, diabetic angiopathies, diabetic retinopathy, embolisms, thrombosis, erythromelalgia, hemorrhoids, hepatic veno-occlusive disease, hypertension, hypotension, ischemia, peripheral vascular diseases, phlebitis, pulmonary veno-occlusive disease, Raynaud's disease, CREST syndrome, retinal vein occlusion, Scimitar syndrome, superior vena cava syndrome, telangiectasia, atacia telangiectasia, hereditary hemorrhagic telangiectasia, varicocele, varicose veins, varicose ulcer, vasculitis, and venous insufficiency.

Aneurysms include, but are not limited to, dissecting aneurysms, false aneurysms, infected aneurysms, ruptured aneurysms, aortic aneurysms, cerebral aneurysms, coronary aneurysms, heart aneurysms, and iliac aneurysms.

Arterial occlusive diseases include, but are not limited to, arteriosclerosis, intermittent claudication, carotid stenosis, fibromuscular dysplasias, mesenteric vascular occlusion, Moyamoya disease, renal artery obstruction, retinal artery occlusion, and thromboangiitis obliterans.

Cerebrovascular disorders include, but are not limited to, carotid artery diseases, cerebral amyloid angiopathy, cerebral aneurysm, cerebral anoxia, cerebral arteriosclerosis, cerebral arteriovenous malformation, cerebral artery diseases, cerebral embolism and thrombosis, carotid artery thrombosis, sinus thrombosis, Wallenberg's syndrome, cerebral hemorrhage, epidural hematoma, subdural hematoma, subaraxhnoid hemorrhage, cerebral infarction, cerebral ischemia (including transient), subclavian steal syndrome, periventricular leukomalacia, vascular headache, cluster headache, migraine, and vertebrobasilar insufficiency.

Embolisms include, but are not limited to, air embolisms, amniotic fluid embolisms, cholesterol embolisms, blue toe syndrome, fat embolisms, pulmonary embolisms, and thromboembolisms. Thrombosis include, but are not limited to, coronary thrombosis, hepatic vein thrombosis, retinal vein occlusion, carotid artery thrombosis, sinus thrombosis, Wallenberg's syndrome, and thrombophlebitis.

Ischemic disorders include, but are not limited to, cerebral ischemia, ischemic colitis, compartment syndromes, anterior compartment syndrome, myocardial ischemia, reperfusion injuries, and peripheral limb ischemia. Vasculitis includes, but is not limited to, aortitis, arteritis, Behcet's Syndrome, Churg-Strauss Syndrome, mucocutaneous lymph node syndrome, thromboangiitis obliterans, hypersensitivity vasculitis, Schoenlein-Henoch purpura, allergic cutaneous vasculitis, and Wegener's granulomatosis.

Polypeptides may be administered using any method known in the art, including, but not limited to, direct needle injection at the delivery site, intravenous injection, topical administration, catheter infusion, biolistic injectors, particle accelerators, gelfoam sponge depots, other commercially available depot materials, osmotic pumps, oral or suppositorial solid pharmaceutical formulations, decanting or topical applications during surgery, aerosol delivery. Such methods are known in the art. Polypeptides may be administered as part of a Therapeutic, described in more detail below. Methods of delivering polynucleotides are described in more detail herein.

Respiratory Disorders

Polynucleotides or polypeptides, or agonists or antagonists of the present invention may be used to treat, prevent, diagnose, and/or prognose diseases and/or disorders of the respiratory system.

Diseases and disorders of the respiratory system include, but are not limited to, nasal vestibulitis, nonallergic rhinitis (e.g., acute rhinitis, chronic rhinitis, atrophic rhinitis, vasomotor rhinitis), nasal polyps, and sinusitis, juvenile angiofibromas, cancer of the nose and juvenile papillomas, vocal cord polyps, nodules (singer's nodules), contact ulcers, vocal cord paralysis, laryngoceles, pharyngitis (e.g., viral and bacterial), tonsillitis, tonsillar cellulitis, parapharyngeal abscess, laryngitis, laryngoceles, and throat cancers (e.g., cancer of the nasopharynx, tonsil cancer, larynx cancer), lung cancer (e.g., squamous cell carcinoma, small cell (oat cell) carcinoma, large cell carcinoma, and adenocarcinoma), allergic disorders (eosinophilic pneumonia, hypersensitivity pneumonitis (e.g., extrinsic allergic alveolitis, allergic interstitial pneumonitis, organic dust pneumoconiosis, allergic bronchopulmonary aspergillosis, asthma, Wegener's granulomatosis (granulomatous vasculitis), Goodpasture's syndrome)), pneumonia (e.g., bacterial pneumonia (e.g., *Streptococcus pneumoniae* (pneumoncoccal pneumonia), *Staphylococcus aureus* (staphylococcal pneumonia), Gram-negative bacterial pneumonia (caused by, e.g., *Klebsiella* and *Pseudomas* spp.), *Mycoplasma pneumoniae* pneumonia, *Hemophilus influenzae* pneumonia, *Legionella pneumophila* (Legionnaires' disease), and *Chlamydia psittaci* (Psittacosis)), and viral pneumonia (e.g., influenza, chickenpox (varicella).

Additional diseases and disorders of the respiratory system include, but are not limited to bronchiolitis, polio (poliomyelitis), croup, respiratory syncytial viral infection, mumps, erythema infectiosum (fifth disease), roseola infantum, progressive rubella panencephalitis, german measles, and subacute sclerosing panencephalitis), fungal pneumonia (e.g., Histoplasmosis, Coccidioidomycosis, Blastomycosis, fungal infections in people with severely suppressed immune systems (e.g., cryptococcosis, caused by *Cryptococcus neoformans*; aspergillosis, caused by *Aspergillus* spp.; candidiasis, caused by *Candida*; and mucormycosis)), *Pneumocystis carinii* (pneumocystis pneumonia), atypical pneumonias (e.g., *Mycoplasma* and *Chlamydia* spp.), opportunistic infection pneumonia, nosocomial pneumonia, chemical pneumonitis, and aspiration pneumonia, pleural disorders (e.g., pleurisy, pleural effusion, and pneumothorax (e.g., simple spontaneous pneumothorax, complicated spontaneous pneumothorax, tension pneumothorax)), obstructive airway diseases (e.g., asthma, chronic obstructive pulmonary disease (COPD), emphysema, chronic or acute bronchitis), occupational lung diseases (e.g., silicosis, black lung (coal workers' pneumoconiosis), asbestosis, berylliosis, occupational asthma, byssinosis, and benign pneumonioses), Infiltrative Lung Disease (e.g., pulmonary fibrosis (e.g., fibrosing alveolitis, usual interstitial pneumonia), idiopathic pulmonary fibrosis, desquamative interstitial pneumonia, lymphoid interstitial pneumonia, histiocytosis X (e.g., Letterer-Siwe disease, Hand-Schüller-Christian disease, eosinophilic granuloma), idiopathic pulmonary hemosiderosis, sarcoidosis and pulmonary alveolar proteinosis), Acute respiratory distress syndrome (also called, e.g., adult respiratory distress syndrome), edema, pulmonary embolism, bronchitis (e.g., viral, bacterial), bronchiectasis, atelectasis, lung abscess (caused by, e.g., *Staphylococcus aureus* or *Legionella pneumophila*), and cystic fibrosis.

Anti-Andogenesis Activity

The naturally occurring balance between endogenous stimulators and inhibitors of angiogenesis is one in which inhibitory influences predominate. Rastinejad et al., *Cell* 56:345-355 (1989). In those rare instances in which neovascularization occurs under normal physiological conditions, such as wound healing, organ regeneration, embryonic development, and female reproductive processes, angiogenesis is stringently regulated and spatially and temporally delimited. Under conditions of pathological angiogenesis such as that characterizing solid tumor growth, these regulatory controls fail. Unregulated angiogenesis becomes pathologic and sustains progression of many neoplastic and non-neoplastic diseases. A number of serious diseases are dominated by abnormal neovascularization including solid tumor growth and metastases, arthritis, some types of eye disorders, and psoriasis. See, e.g., reviews by Moses et al., *Biotech.* 9:630-634 (1991); Folkman et al., *N Engl. J. Med.*, 333:1757-1763 (1995); Auerbach et al., *J. Microvasc. Res.* 29:401-411 (1985); Folkman, Advances in Cancer Research, eds. Klein and Weinhouse, Academic Press, New York, pp. 175-203 (1985); Patz, *Am. J. Opthalmol.* 94:715-743 (1982); and Folkman et al., Science 221:719-725 (1983). In a number of pathological conditions, the process of angiogenesis contributes to the disease state. For example, significant data have accumulated which suggest that the growth of solid tumors is dependent on angiogenesis. Folkman and Klagsbrun, *Science* 235:442-447 (1987).

The present invention provides for treatment of diseases or disorders associated with neovascularization by administration of the polynucleotides and/or polypeptides of the invention, as well as agonists or antagonists of the present invention. Malignant and metastatic conditions which can be treated with the polynucleotides and polypeptides, or agonists or antagonists of the invention include, but are not limited to, malignancies, solid tumors, and cancers described herein and otherwise known in the art (for a review of such disorders, see Fishman et al., Medicine, 2d Ed., J. B. Lippincott Co., Philadelphia (1985)).Thus, the present invention provides a method of treating an angiogenesis-related disease and/or disorder, comprising administering to an individual in need thereof a therapeutically effective amount of a polynucleotide, polypeptide, antagonist and/or agonist of the invention. For example, polynucleotides, polypeptides, antagonists and/or agonists may be utilized in a variety of additional methods in order to therapeutically treat a cancer or tumor. Cancers which may be treated with polynucleotides, polypeptides, antagonists and/or agonists include, but are not limited to solid tumors, including prostate, lung, breast, ovarian, stomach, pancreas, larynx, esophagus, testes, liver, parotid, biliary tract, colon, rectum, cervix, uterus, endometrium, kidney, bladder, thyroid cancer; primary tumors and metastases; melanomas; glioblastoma; Kaposi's sarcoma; leiomyosarcoma; non-small cell lung cancer; colorectal cancer; advanced malignancies; and blood born tumors such as leukemias. For example, polynucleotides, polypeptides, antagonists and/or agonists may be delivered topically, in order to treat cancers such as skin cancer, head and neck tumors, breast tumors, and Kaposi's sarcoma.

Within yet other aspects, polynucleotides, polypeptides, antagonists and/or agonists may be utilized to treat superficial forms of bladder cancer by, for example, intravesical administration. Polynucleotides, polypeptides, antagonists and/or agonists may be delivered directly into the tumor, or near the tumor site, via injection or a catheter. Of course, as the artisan of ordinary skill will appreciate, the appropriate mode of administration will vary according to the cancer to be treated. Other modes of delivery are discussed herein.

Polynucleotides, polypeptides, antagonists and/or agonists may be useful in treating other disorders, besides cancers, which involve angiogenesis. These disorders include, but are not limited to: benign tumors, for example hemangiomas, acoustic neuromas, neurofibromas, trachomas, and pyogenic granulomas; artheroscleric plaques; ocular angiogenic diseases, for example, diabetic retinopathy, retinopathy of prematurity, macular degeneration, corneal graft rejection, neovascular glaucoma, retrolental fibroplasia, rubeosis, retinoblastoma, uvietis and Pterygia (abnormal blood vessel growth) of the eye; rheumatoid arthritis; psoriasis; delayed wound healing; endometriosis; vasculogenesis; granulations; hypertrophic scars (keloids); nonunion fractures; scleroderma; trachoma; vascular adhesions; myocardial angiogenesis; coronary collaterals; cerebral collaterals; arteriovenous malformations; ischemic limb angiogenesis; Osler-Webber Syndrome; plaque neovascularization; telangiectasia; hemophiliac joints; angiofibroma; fibromuscular dysplasia; wound granulation; Crohn's disease; and atherosclerosis.

For example, within one aspect of the present invention methods are provided for treating hypertrophic scars and keloids, comprising the step of administering a polynucleotide, polypeptide, antagonist and/or agonist of the invention to a hypertrophic scar or keloid.

Within one embodiment of the present invention polynucleotides, polypeptides, antagonists and/or agonists of the invention are directly injected into a hypertrophic scar or keloid, in order to prevent the progression of these lesions. This therapy is of particular value in the prophylactic treatment of conditions which are known to result in the development of hypertrophic scars and keloids (e.g., burns), and is preferably initiated after the proliferative phase has had time to progress (approximately 14 days after the initial injury), but before hypertrophic scar or keloid development. As noted above, the present invention also provides methods for treating neovascular diseases of the eye, including for example, corneal neovascularization, neovascular glaucoma, proliferative diabetic retinopathy, retrolental fibroplasia and macular degeneration.

Moreover, Ocular disorders associated with neovascularization which can be treated with the polynucleotides and polypeptides of the present invention (including agonists and/or antagonists) include, but are not limited to: neovascular glaucoma, diabetic retinopathy, retinoblastoma, retrolental fibroplasia, uveitis, retinopathy of prematurity macular degeneration, corneal graft neovascularization, as well as other eye inflammatory diseases, ocular tumors and diseases associated with choroidal or iris neovascularization. See, e.g., reviews by Waltman et al., *Am. J. Ophthal.* 85:704-710 (1978) and Gartner et al., *Surv. Ophthal.* 22:291-312 (1978).

Thus, within one aspect of the present invention methods are provided for treating neovascular diseases of the eye such as corneal neovascularization (including corneal graft neovascularization), comprising the step of administering to a patient a therapeutically effective amount of a compound (as described above) to the cornea, such that the formation of blood vessels is inhibited. Briefly, the cornea is a tissue which normally lacks blood vessels. In certain pathological conditions however, capillaries may extend into the cornea from the pericorneal vascular plexus of the limbus. When the cornea becomes vascularized, it also becomes clouded, resulting in a decline in the patient's visual acuity. Visual loss may become complete if the cornea completely opacitates. A wide variety of disorders can result in corneal neovascularization, including for example, corneal infections (e.g., trachoma, herpes simplex keratitis, leishmaniasis and onchocerciasis), immunological processes (e.g., graft rejection and Stevens-Johnson's syndrome), alkali burns, trauma, inflammation (of any cause), toxic and nutritional deficiency states, and as a complication of wearing contact lenses.

Within particularly preferred embodiments of the invention, may be prepared for topical administration in saline (combined with any of the preservatives and antimicrobial agents commonly used in ocular preparations), and administered in eyedrop form. The solution or suspension may be prepared in its pure form and administered several times daily. Alternatively, anti-angiogenic compositions, prepared as described above, may also be administered directly to the cornea. Within preferred embodiments, the anti-angiogenic composition is prepared with a muco-adhesive polymer which binds to cornea. Within further embodiments, the anti-angiogenic factors or anti-angiogenic compositions may be utilized as an adjunct to conventional steroid therapy. Topical therapy may also be useful prophylactically in corneal lesions which are known to have a high probability of inducing an angiogenic response (such as chemical burns). In these instances the treatment, likely in combination with steroids, may be instituted immediately to help prevent subsequent complications.

Within other embodiments, the compounds described above may be injected directly into the corneal stroma by an ophthalmologist under microscopic guidance. The preferred site of injection may vary with the morphology of the individual lesion, but the goal of the administration would be to place the composition at the advancing front of the vasculature (i.e., interspersed between the blood vessels and the normal cornea). In most cases this would involve perilimbic corneal injection to "protect" the cornea from the advancing blood vessels. This method may also be utilized shortly after a corneal insult in order to prophylactically prevent corneal neovascularization. In this situation the material could be injected in the perilimbic cornea interspersed between the corneal lesion and its undesired potential limbic blood supply. Such methods may also be utilized in a similar fashion to prevent capillary invasion of transplanted corneas. In a sustained-release form injections might only be required 2-3 times per year. A steroid could also be added to the injection solution to reduce inflammation resulting from the injection itself.

Within another aspect of the present invention, methods are provided for treating neovascular glaucoma, comprising the step of administering to a patient a therapeutically effective amount of a polynucleotide, polypeptide, antagonist and/or agonist to the eye, such that the formation of blood vessels is inhibited. In one embodiment, the compound may be administered topically to the eye in order to treat early forms of neovascular glaucoma. Within other embodiments, the compound may be implanted by injection into the region of the anterior chamber angle. Within other embodiments, the compound may also be placed in any location such that the compound is continuously released into the aqueous humor. Within another aspect of the present invention, methods are provided for treating proliferative diabetic retinopathy, comprising the step of administering to a patient a therapeutically effective amount of a polynucleotide, polypeptide, antagonist and/or agonist to the eyes, such that the formation of blood vessels is inhibited.

Within particularly preferred embodiments of the invention, proliferative diabetic retinopathy may be treated by injection into the aqueous humor or the vitreous, in order to increase the local concentration of the polynucleotide, polypeptide, antagonist and/or agonist in the retina. Preferably, this treatment should be initiated prior to the acquisition of severe disease requiring photocoagulation.

Within another aspect of the present invention, methods are provided for treating retrolental fibroplasia, comprising the step of administering to a patient a therapeutically effective amount of a polynucleotide, polypeptide, antagonist and/or agonist to the eye, such that the formation of blood vessels is inhibited. The compound may be administered topically, via intravitreous injection and/or via intraocular implants.

Additionally, disorders which can be treated with the polynucleotides, polypeptides, agonists and/or agonists include, but are not limited to, hemangioma, arthritis, psoriasis, angiofibroma, atherosclerotic plaques, delayed wound healing, granulations, hemophilic joints, hypertrophic scars, nonunion fractures, Osler-Weber syndrome, pyogenic granuloma, scleroderma, trachoma, and vascular adhesions.

Moreover, disorders and/or states, which can be treated, prevented, diagnosed, and/or prognosed with the polynucleotides, polypeptides, agonists and/or agonists of the invention include, but are not limited to, solid tumors, blood born tumors such as leukemias, tumor metastasis, Kaposi's sarcoma, benign tumors, for example hemangiomas, acoustic neuromas, neurofibromas, trachomas, and pyogenic granulomas, rheumatoid arthritis, psoriasis, ocular angiogenic diseases, for example, diabetic retinopathy, retinopathy of prematurity, macular degeneration, corneal graft rejection, neovascular glaucoma, retrolental fibroplasia, rubeosis, retinoblastoma, and uvietis, delayed wound healing, endometriosis, vascluogenesis, granulations, hypertrophic scars (keloids), nonunion fractures, scleroderma, trachoma, vascular adhesions, myocardial angiogenesis, coronary collaterals, cerebral collaterals, arteriovenous malformations, ischemic limb angiogenesis, Osler-Webber Syndrome, plaque neovascularization, telangiectasia, hemophiliac joints, angiofibroma fibromuscular dysplasia, wound granulation, Crohn's disease, atherosclerosis, birth control agent by preventing vascularization required for embryo implantation controlling menstruation, diseases that have angiogenesis as a pathologic consequence such as cat scratch disease (Rochele minalia quintosa), ulcers (*Helicobacter pylori*), Bartonellosis and bacillary angiomatosis.

In one aspect of the birth control method, an amount of the compound sufficient to block embryo implantation is administered before or after intercourse and fertilization have occurred, thus providing an effective method of birth control, possibly a "morning after" method. Polynucleotides, polypeptides, agonists and/or agonists may also be used in controlling menstruation or administered as either a peritoneal lavage fluid or for peritoneal implantation in the treatment of endometriosis.

Polynucleotides, polypeptides, agonists and/or agonists of the present invention may be incorporated into surgical sutures in order to prevent stitch granulomas.

Polynucleotides, polypeptides, agonists and/or agonists may be utilized in a wide variety of surgical procedures. For example, within one aspect of the present invention a compositions (in the form of, for example, a spray or film) may be utilized to coat or spray an area prior to removal of a tumor, in order to isolate normal surrounding tissues from malignant tissue, and/or to prevent the spread of disease to surrounding tissues. Within other aspects of the present invention, compositions (e.g., in the form of a spray) may be delivered via endoscopic procedures in order to coat tumors, or inhibit angiogenesis in a desired locale. Within yet other aspects of the present invention, surgical meshes which have been coated with anti-angiogenic compositions of the present invention may be utilized in any procedure wherein a surgical mesh might be utilized. For example, within one embodiment of the invention a surgical mesh laden with an anti-angiogenic composition may be utilized during abdominal cancer resection surgery (e.g., subsequent to colon resection) in order to provide support to the structure, and to release an amount of the anti-angiogenic factor.

Within further aspects of the present invention, methods are provided for treating tumor excision sites, comprising administering a polynucleotide, polypeptide, agonist and/or agonist to the resection margins of a tumor subsequent to excision, such that the local recurrence of cancer and the formation of new blood vessels at the site is inhibited. Within one embodiment of the invention, the anti-angiogenic compound is administered directly to the tumor excision site (e.g., applied by swabbing, brushing or otherwise coating the resection margins of the tumor with the anti-angiogenic compound). Alternatively, the anti-angiogenic compounds may be incorporated into known surgical pastes prior to administration. Within particularly preferred embodiments of the invention, the anti-angiogenic compounds are applied after hepatic resections for malignancy, and after neurosurgical operations.

Within one aspect of the present invention, polynucleotides, polypeptides, agonists and/or agonists may be administered to the resection margin of a wide variety of tumors, including for example, breast, colon, brain and hepatic tumors. For example, within one embodiment of the invention, anti-angiogenic compounds may be administered to the site of a neurological tumor subsequent to excision, such that the formation of new blood vessels at the site are inhibited.

The polynucleotides, polypeptides, agonists and/or agonists of the present invention may also be administered along with other anti-angiogenic factors. Representative examples of other anti-angiogenic factors include: Anti-Invasive Factor, retinoic acid and derivatives thereof, paclitaxel, Suramin, Tissue Inhibitor of Metalloproteinase-1, Tissue Inhibitor of Metalloproteinase-2, Plasminogen Activator Inhibitor-1, Plasminogen Activator Inhibitor-2, and various forms of the lighter "d group" transition metals.

Lighter "d group" transition metals include, for example, vanadium, molybdenum, tungsten, titanium, niobium, and tantalum species. Such transition metal species may form transition metal complexes. Suitable complexes of the above-mentioned transition metal species include oxo transition metal complexes.

Representative examples of vanadium complexes include oxo vanadium complexes such as vanadate and vanadyl complexes. Suitable vanadate complexes include metavanadate and orthovanadate complexes such as, for example, ammonium metavanadate, sodium metavanadate, and sodium orthovanadate. Suitable vanadyl complexes include, for example, vanadyl acetylacetonate and vanadyl sulfate including vanadyl sulfate hydrates such as vanadyl sulfate mono- and trihydrates.

Representative examples of tungsten and molybdenum complexes also include oxo complexes. Suitable oxo tungsten complexes include tungstate and tungsten oxide complexes. Suitable tungstate complexes include ammonium tungstate, calcium tungstate, sodium tungstate dihydrate, and tungstic acid. Suitable tungsten oxides include tungsten (IV) oxide and tungsten (VI) oxide. Suitable oxo molybdenum complexes include molybdate, molybdenum oxide, and molybdenyl complexes. Suitable molybdate complexes include ammonium molybdate and its hydrates, sodium molybdate and its hydrates, and potassium molybdate and its hydrates. Suitable molybdenum oxides include molybdenum (VI) oxide, molybdenum (VI) oxide, and molybdic acid. Suitable molybdenyl complexes include, for example, molybdenyl acetylacetonate. Other suitable tungsten and molybdenum complexes include hydroxo derivatives derived from, for example, glycerol, tartaric acid, and sugars.

A wide variety of other anti-angiogenic factors may also be utilized within the context of the present invention. Representative examples include platelet factor 4; protamine sulphate; sulphated chitin derivatives (prepared from queen crab shells), (Murata et al., Cancer Res. 51:22-26, 1991); Sulphated Polysaccharide Peptidoglycan Complex (SP-PG) (the function of this compound may be enhanced by the presence of steroids such as estrogen, and tamoxifen citrate); Staurosporine; modulators of matrix metabolism, including for example, proline analogs, cishydroxyproline, d,L-3,4-dehydroproline, Thiaproline, alpha,alpha-dipyridyl, aminopropionitrile fumarate; 4-propyl-5-(4-pyridinyl)-2(3H)-oxazolone; Methotrexate; Mitoxantrone; Heparin; Interferons; 2 Macroglobulin-serum; ChIMP-3 (Pavloff et al., J. Bio. Chem. 267:17321-17326, 1992); Chymostatin (Tomkinson et al., Biochem J. 286:475-480, 1992); Cyclodextrin Tetradecasulfate; Eponemycin; Camptothecin; Fumagillin (Ingber et al., Nature 348:555-557, 1990); Gold Sodium Thiomalate ("GST"; Matsubara and Ziff, J. Clin. Invest. 79:1440-1446, 1987); anticollagenase-serum; alpha2-antiplasmin (Holmes et al., J. Biol. Chem. 262(4):1659-1664, 1987); Bisantrene (National Cancer Institute); Lobenzarit disodium (N-(2)-carboxyphenyl-4-chloroanthronilic acid disodium or "CCA"; Takeuchi et al., Agents Actions 36:312-316, 1992); Thalidomide; Angostatic steroid; AGM-1470; carboxynaminolmidazole; and metalloproteinase inhibitors such as BB94.

Diseases at the Cellular Level

Diseases associated with increased cell survival or the inhibition of apoptosis that could be treated, prevented, diagnosed, and/or prognosed using polynucleotides or polypeptides, as well as antagonists or agonists of the present invention, include cancers (such as follicular lymphomas, carcinomas with p53 mutations, and hormone-dependent tumors, including, but not limited to colon cancer, cardiac tumors, pancreatic cancer, melanoma, retinoblastoma, glioblastoma, lung cancer, intestinal cancer, testicular cancer, stomach cancer, neuroblastoma, myxoma, myoma, lymphoma, endothelioma, osteoblastoma, osteoclastoma, osteosarcoma, chondrosarcoma, adenoma, breast cancer, prostate cancer, Kaposi's sarcoma and ovarian cancer); autoimmune disorders (such as, multiple sclerosis, Sjogren's syndrome, Hashimoto's thyroiditis, biliary cirrhosis, Behcet's disease, Crohn's disease, polymyositis, systemic lupus erythematosus and immune-related glomerulonephritis and rheumatoid arthritis) and viral infections (such as herpes viruses, pox viruses and adenoviruses), inflammation, graft v. host disease, acute graft rejection, and chronic graft rejection.

In preferred embodiments, polynucleotides, polypeptides, and/or antagonists of the invention are used to inhibit growth, progression, and/or metasis of cancers, in particular those listed above.

Additional diseases or conditions associated with increased cell survival that could be treated or detected by polynucleotides or polypeptides, or agonists or antagonists of the present invention include, but are not limited to, progression, and/or metastases of malignancies and related disorders such as leukemia (including acute leukemias (e.g., acute lymphocytic leukemia, acute myelocytic leukemia (including myeloblastic, promyelocytic, myelomonocytic, monocytic, and erythroleukemia)) and chronic leukemias (e.g., chronic myelocytic (granulocytic) leukemia and chronic lymphocytic leukemia)), polycythemia vera, lymphomas (e.g., Hodgkin's disease and non-Hodgkin's disease), multiple myeloma, Waldenstrom's macroglobulinemia, heavy chain disease, and solid tumors including, but not limited to, sarcomas and carcinomas such as fibrosarcoma, myxosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, Ewing's tumor, leiomyosarcoma, rhabdomyosarcoma, colon carcinoma, pancreatic cancer, breast cancer, ovarian cancer, prostate cancer, squamous cell carcinoma, basal cell carcinoma, adenocarcinoma, sweat gland carcinoma, sebaceous gland carcinoma, papillary carcinoma, papillary adenocarcinomas, cystadenocarcinoma, medullary carcinoma, bronchogenic carcinoma, renal cell carcinoma, hepatoma, bile duct carcinoma, choriocarcinoma, seminoma, embryonal carcinoma, Wilm's tumor, cervical cancer, testicular tumor, lung carcinoma, small cell lung carcinoma, bladder carcinoma, epithelial carcinoma, glioma, astrocytoma, medulloblastoma, craniopharyngioma, ependymoma, pinealoma, hemangioblastoma, acoustic neuroma, oligodendroglioma, menangioma, melanoma, neuroblastoma, and retinoblastoma.

Diseases associated with increased apoptosis that could be treated, prevented, diagnosed, and/or prognesed using polynucleotides or polypeptides, as well as agonists or antagonists of the present invention, include, but are not limited to, AIDS; neurodegenerative disorders (such as Alzheimer's disease, Parkinson's disease, Amyotrophic lateral sclerosis, Retinitis pigmentosa, Cerebellar degeneration and brain tumor or prior associated disease); autoimmune disorders (such as, multiple sclerosis, Sjogren's syndrome, Hashimoto's thyroiditis, biliary cirrhosis, Behcet's disease, Crohn's disease, polymyositis, systemic lupus erythematosus and immune-related glomerulonephritis and rheumatoid arthritis) myelodysplastic syndromes (such as aplastic anemia), graft v. host disease, ischemic injury (such as that caused by myocardial infarction, stroke and reperfusion injury), liver injury (e.g., hepatitis related liver injury, ischemia/reperfusion injury, cholestosis (bile duct injury) and liver cancer); toxin-induced liver disease (such as that caused by alcohol), septic shock, cachexia and anorexia.

Wound Healing and Epithelial Cell Proliferation

In accordance with yet a further aspect of the present invention, there is provided a process for utilizing polynucleotides or polypeptides, as well as agonists or antagonists of the present invention, for therapeutic purposes, for example, to stimulate epithelial cell proliferation and basal keratinocytes for the purpose of wound healing, and to stimulate hair follicle production and healing of dermal wounds. Polynucleotides or polypeptides, as well as agonists or antagonists of the present invention, may be clinically useful in stimulating wound healing including surgical wounds, excisional wounds, deep wounds involving damage of the dermis and epidermis, eye tissue wounds, dental tissue wounds, oral cavity wounds, diabetic ulcers, dermal ulcers, cubitus ulcers, arterial ulcers, venous stasis ulcers, burns resulting from heat exposure or chemicals, and other abnormal wound healing conditions such as uremia, malnutrition, vitamin deficiencies and complications associated with systemic treatment with steroids, radiation therapy and antineoplastic drugs and antimetabolites. Polynucleotides or polypeptides, as well as agonists or antagonists of the present invention, could be used to promote dermal reestablishment subsequent to dermal loss Polynucleotides or polypeptides, as well as agonists or antagonists of the present invention, could be used to increase the adherence of skin grafts to a wound bed and to stimulate re-epithelialization from the wound bed. The following are types of grafts that polynucleotides or polypeptides, agonists or antagonists of the present invention, could be used to increase adherence to a wound bed: autografts, artificial skin, allografts, autodermic graft, autoepdermic grafts, avacular grafts, Blair-Brown grafts, bone graft, brephoplastic grafts, cutis graft, delayed graft, dermic graft, epidermic graft, fascia graft, full thickness graft, heterologous graft, xenograft, homologous graft, hyperplastic graft, lamellar graft, mesh graft, mucosal graft, Ollier-Thiersch graft, omenpal graft, patch graft, pedicle graft, penetrating graft, split skin graft, thick split graft. Polynucleotides or polypeptides, as well as agonists or antagonists of the present invention, can be used to promote skin strength and to improve the appearance of aged skin.

It is believed that polynucleotides or polypeptides, as well as agonists or antagonists of the present invention, will also produce changes in hepatocyte proliferation, and epithelial cell proliferation in the lung, breast, pancreas, stomach, small intestine, and large intestine. Polynucleotides or polypeptides, as well as agonists or antagonists of the present invention, could promote proliferation of epithelial cells such as sebocytes, hair follicles, hepatocytes, type II pneumocytes, mucin-producing goblet cells, and other epithelial cells and their progenitors contained within the skin, lung, liver, and gastrointestinal tract. Polynucleotides or polypeptides, agonists or antagonists of the present invention, may promote proliferation of endothelial cells, keratinocytes, and basal keratinocytes.

Polynucleotides or polypeptides, as well as agonists or antagonists of the present invention, could also be used to reduce the side effects of gut toxicity that result from radiation, chemotherapy treatments or viral infections. Polynucleotides or polypeptides, as well as agonists or antagonists of the present invention, may have a cytoprotective effect on the small intestine mucosa. Polynucleotides or polypeptides, as well as agonists or antagonists of the present invention, may also stimulate healing of mucositis (mouth ulcers) that result from chemotherapy and viral infections.

Polynucleotides or polypeptides, as well as agonists or antagonists of the present invention, could further be used in full regeneration of skin in full and partial thickness skin defects, including burns, (i.e., repopulation of hair follicles, sweat glands, and sebaceous glands), treatment of other skin defects such as psoriasis. Polynucleotides or polypeptides, as well as agonists or antagonists of the present invention, could be used to treat epidermolysis bullosa, a defect in adherence of the epidermis to the underlying dermis which results in frequent, open and painful blisters by accelerating reepithelialization of these lesions. Polynucleotides or polypeptides, as well as agonists or antagonists of the present invention, could also be used to treat gastric and doudenal ulcers and help heal by scar formation of the mucosal lining and regeneration of glandular mucosa and duodenal mucosal lining more rapidly. Inflammatory bowel diseases, such as Crohn's disease and ulcerative colitis, are diseases which result in destruction of the mucosal surface of the small or large intestine, respectively. Thus, polynucleotides or polypeptides, as well as agonists or antagonists of the present invention, could be used to promote the resurfacing of the mucosal surface to aid more rapid healing and to prevent progression of inflammatory bowel disease. Treatment with polynucleotides or polypeptides, agonists or antagonists of the present invention, is expected to have a significant effect on the production of mucus throughout the gastrointestinal tract and could be used to protect the intestinal mucosa from injurious substances that are ingested or following surgery. Polynucleotides or polypeptides, as well as agonists or antagonists of the present invention, could be used to treat diseases associate with the under expression.

Moreover, polynucleotides or polypeptides, as well as agonists or antagonists of the present invention, could be used to prevent and heal damage to the lungs due to various pathological states. Polynucleotides or polypeptides, as well as agonists or antagonists of the present invention, which could stimulate proliferation and differentiation and promote the repair of alveoli and brochiolar epithelium to prevent or treat acute or chronic lung damage. For example, emphysema, which results in the progressive loss of aveoli, and inhalation injuries, i.e., resulting from smoke inhalation and burns, that cause necrosis of the bronchiolar epithelium and alveoli could be effectively treated using polynucleotides or polypeptides, agonists or antagonists of the present invention. Also, polynucleotides or polypeptides, as well as agonists or antagonists of the present invention, could be used to stimulate the proliferation of and differentiation of type II pneumocytes, which may help treat or prevent disease such as hyaline membrane diseases, such as infant respiratory distress syndrome and bronchopulmonary displasia, in premature infants.

Polynucleotides or polypeptides, as well as agonists or antagonists of the present invention, could stimulate the proliferation and differentiation of hepatocytes and, thus, could be used to alleviate or treat liver diseases and pathologies such as fulminant liver failure caused by cirrhosis, liver damage caused by viral hepatitis and toxic substances (i.e., acetaminophen, carbon tetraholoride and other hepatotoxins known in the art).

In addition, polynucleotides or polypeptides, as well as agonists or antagonists of the present invention, could be used treat or prevent the onset of diabetes mellitus. In patients with newly diagnosed Types I and II diabetes, where some islet cell function remains, polynucleotides or polypeptides, as well as agonists or antagonists of the present invention, could be used to maintain the islet function so as to alleviate, delay or prevent permanent manifestation of the disease. Also, polynucleotides or polypeptides, as well as agonists or antagonists of the present invention, could be used as an auxiliary in islet cell transplantation to improve or promote islet cell function.

Neural Activity and Neurological Diseases

The polynucleotides, polypeptides and agonists or antagonists of the invention may be used for the diagnosis and/or treatment of diseases, disorders, damage or injury of the brain and/or nervous system. Nervous system disorders that can be treated with the compositions of the invention (e.g., polypeptides, polynucleotides, and/or agonists or antagonists), include, but are not limited to, nervous system injuries, and diseases or disorders which result in either a disconnection of axons, a diminution or degeneration of neurons, or demyelination. Nervous system lesions which may be treated in a patient (including human and non-human mammalian patients) according to the methods of the invention, include but are not limited to, the following lesions of either the central (including spinal cord, brain) or peripheral nervous systems: (1) ischemic lesions, in which a lack of oxygen in a portion of the nervous system results in neuronal injury or death, including cerebral infarction or ischemia, or spinal cord infarction or ischemia; (2) traumatic lesions, including lesions caused by physical injury or associated with surgery, for example, lesions which sever a portion of the nervous system, or compression injuries; (3) malignant lesions, in which a portion of the nervous system is destroyed or injured by malignant tissue which is either a nervous system associated malignancy or a malignancy derived from non-nervous system tissue; (4) infectious lesions, in which a portion of the nervous system is destroyed or injured as a result of infection, for example, by an abscess or associated with infection by human immunodeficiency virus, herpes zoster, or herpes simplex virus or with Lyme disease, tuberculosis, or syphilis; (5) degenerative lesions, in which a portion of the nervous system is destroyed or injured as a result of a degenerative process including but not limited to, degeneration associated with Parkinson's disease, Alzheimer's disease, Huntington's chorea, or amyotrophic lateral sclerosis (ALS); (6) lesions associated with nutritional diseases or disorders, in which a portion of the nervous system is destroyed or injured by a nutritional disorder or disorder of metabolism including, but not limited to, vitamin B12 deficiency, folic acid deficiency, Wernicke disease, tobacco-alcohol amblyopia, Marchiafava-Bignami disease (primary degeneration of the corpus callosum), and alcoholic cerebellar degeneration; (7) neurological lesions associated with systemic diseases including, but not limited to, diabetes (diabetic neuropathy, Bell's palsy), systemic lupus erythematosus, carcinoma, or sarcoidosis; (8) lesions caused by toxic substances including alcohol, lead, or particular neurotoxins; and (9) demyelinated lesions in which a portion of the nervous system is destroyed or injured by a demyelinating disease including, but not limited to, multiple sclerosis, human immunodeficiency virus-associated myelopathy, transverse myelopathy or various etiologies, progressive multifocal leukoencephalopathy, and central pontine myelinolysis.

In one embodiment, the polypeptides, polynucleotides, or agonists or antagonists of the invention are used to protect neural cells from the damaging effects of hypoxia. In a further preferred embodiment, the polypeptides, polynucleotides, or agonists or antagonists of the invention are used to protect neural cells from the damaging effects of cerebral hypoxia. According to this embodiment, the compositions of the invention are used to treat or prevent neural cell injury associated with cerebral hypoxia. In one non-exclusive aspect of this embodiment, the polypeptides, polynucleotides, or agonists or antagonists of the invention, are used to treat or prevent neural cell injury associated with cerebral ischemia. In another non-exclusive aspect of this embodiment, the polypeptides, polynucleotides, or agonists or antagonists of the invention are used to treat or prevent neural cell injury associated with cerebral infarction.

In another preferred embodiment, the polypeptides, polynucleotides, or agonists or antagonists of the invention are used to treat or prevent neural cell injury associated with a stroke. In a specific embodiment, the polypeptides, polynucleotides, or agonists or antagonists of the invention are used to treat or prevent cerebral neural cell injury associated with a stroke.

In another preferred embodiment, the polypeptides, polynucleotides, or agonists or antagonists of the invention are used to treat or prevent neural cell injury associated with a heart attack. In a specific embodiment, the polypeptides, polynucleotides, or agonists or antagonists of the invention are used to treat or prevent cerebral neural cell injury associated with a heart attack.

The compositions of the invention which are useful for treating or preventing a nervous system disorder may be selected by testing for biological activity in promoting the survival or differentiation of neurons. For example, and not by way of limitation, compositions of the invention which elicit any of the following effects may be useful according to the invention: (1) increased survival time of neurons in culture either in the presence or absence of hypoxia or hypoxic conditions; (2) increased sprouting of neurons in culture or in vivo; (3) increased production of a neuron-associated molecule in culture or in vivo, e.g., choline acetyltransferase or acetylcholinesterase with respect to motor neurons; or (4) decreased symptoms of neuron dysfunction in vivo. Such effects may be measured by any method known in the art. In preferred, non-limiting embodiments, increased survival of neurons may routinely be measured using a method set forth herein or otherwise known in the art, such as, for example, in Zhang et al., *Proc Natl Acad Sci USA* 97:3637-42 (2000) or in Arakawa et al., J. Neurosci., 10:3507-15 (1990); increased sprouting of neurons may be detected by methods known in the art, such as, for example, the methods set forth in Pestronk et al., *Exp. Neurol.*, 70:65-82 (1980), or Brown et al., *Ann. Rev. Neurosci.*, 4:17-42 (1981); increased production of neuron-associated molecules may be measured by bioassay, enzymatic assay, antibody binding, Northern blot assay, etc., using techniques known in the art and depending on the molecule to be measured; and motor neuron dysfunction may be measured by assessing the physical manifestation of motor neuron disorder, e.g., weakness, motor neuron conduction velocity, or functional disability.

In specific embodiments, motor neuron disorders that may be treated according to the invention include, but are not limited to, disorders such as infarction, infection, exposure to toxin, trauma, surgical damage, degenerative disease or malignancy that may affect motor neurons as well as other components of the nervous system, as well as disorders that selectively affect neurons such as amyotrophic lateral sclerosis, and including, but not limited to, progressive spinal muscular atrophy, progressive bulbar palsy, primary lateral sclerosis, infantile and juvenile muscular atrophy, progressive bulbar paralysis of childhood (Fazio-Londe syndrome), poliomyelitis and the post polio syndrome, and Hereditary Motorsensory Neuropathy (Charcot-Marie-Tooth Disease).

Further, polypeptides or polynucleotides of the invention may play a role in neuronal survival; synapse formation; conductance; neural differentiation, etc. Thus, compositions of the invention (including polynucleotides, polypeptides, and agonists or antagonists) may be used to diagnose and/or treat or prevent diseases or disorders associated with these roles, including, but not limited to, learning and/or cognition disorders. The compositions of the invention may also be useful in the treatment or prevention of neurodegenerative disease states and/or behavioural disorders. Such neurodegenerative disease states and/or behavioral disorders include, but are not limited to, Alzheimer's Disease, Parkinson's Disease, Huntington's Disease, Tourette Syndrome, schizophrenia, mania, dementia, paranoia, obsessive compulsive disorder, panic disorder, learning disabilities, ALS, psychoses, autism, and altered behaviors, including disorders in feeding, sleep patterns, balance, and perception. In addition, compositions of the invention may also play a role in the treatment, prevention and/or detection of developmental disorders associated with the developing embryo, or sexually-linked disorders.

Additionally, polypeptides, polynucleotides and/or agonists or antagonists of the invention, may be useful in protecting neural cells from diseases, damage, disorders, or injury, associated with cerebrovascular disorders including, but not limited to, carotid artery diseases (e.g., carotid artery thrombosis, carotid stenosis, or Moyamoya Disease), cerebral amyloid angiopathy, cerebral aneurysm, cerebral anoxia, cerebral arteriosclerosis, cerebral arteriovenous malformations, cerebral artery diseases, cerebral embolism and thrombosis (e.g., carotid artery thrombosis, sinus thrombosis, or Wallenberg's Syndrome), cerebral hemorrhage (e.g., epidural or subdural hematoma, or subarachnoid hemorrhage), cerebral infarction, cerebral ischemia (e.g., transient cerebral ischemia, Subclavian Steal Syndrome, or vertebrobasilar insufficiency), vascular dementia (e.g., multi-infarct), leukomalacia, periventricular, and vascular headache (e.g., cluster headache or migraines).

In accordance with yet a further aspect of the present invention, there is provided a process for utilizing polynucleotides or polypeptides, as well as agonists or antagonists of the present invention, for therapeutic purposes, for example, to stimulate neurological cell proliferation and/or differentiation. Therefore, polynucleotides, polypeptides, agonists and/or antagonists of the invention may be used to treat and/or detect neurologic diseases. Moreover, polynucleotides or polypeptides, or agonists or antagonists of the invention, can be used as a marker or detector of a particular nervous system disease or disorder.

Examples of neurologic diseases which can be treated or detected with polynucleotides, polypeptides, agonists, and/or antagonists of the present invention include brain diseases, such as metabolic brain diseases which includes phenylketonuria such as maternal phenylketonuria, pyruvate carboxylase deficiency, pyruvate dehydrogenase complex deficiency, Wernicke's Encephalopathy, brain edema, brain neoplasms such as cerebellar neoplasms which include infratentorial neoplasms, cerebral ventricle neoplasms such as choroid plexus neoplasms, hypothalamic neoplasms, supratentorial neoplasms, canavan disease, cerebellar diseases such as cerebellar ataxia which include spinocerebellar degeneration such as ataxia telangiectasia, cerebellar dyssynergia, Friederich's Ataxia, Machado-Joseph Disease, olivopontocerebellar atrophy, cerebellar neoplasms such as infratentorial neoplasms, diffuse cerebral sclerosis such as encephalitis periaxialis, globoid cell leukodystrophy, metachromatic leukodystrophy and subacute sclerosing panencephalitis.

Additional neurologic diseases which can be treated or detected with polynucleotides, polypeptides, agonists, and/or antagonists of the present invention include cerebrovascular disorders (such as carotid artery diseases which include carotid artery thrombosis, carotid stenosis and Moyamoya Disease), cerebral amyloid angiopathy, cerebral aneurysm, cerebral anoxia, cerebral arteriosclerosis, cerebral arteriovenous malformations, cerebral artery diseases, cerebral embolism and thrombosis such as carotid artery thrombosis, sinus thrombosis and Wallenberg's Syndrome, cerebral hemorrhage such as epidural hematoma, subdural hematoma and subarachnoid hemorrhage, cerebral infarction, cerebral ischemia such as transient cerebral ischemia, Subclavian Steal Syndrome and vertebrobasilar insufficiency, vascular dementia such as multi-infarct dementia, periventricular leukomalacia, vascular headache such as cluster headache and migraine.

Additional neurologic diseases which can be treated or detected with polynucleotides, polypeptides, agonists, and/or antagonists of the present invention include dementia such as AIDS Dementia Complex, presenile dementia such as Alzheimer's Disease and Creutzfeldt-Jakob Syndrome, senile dementia such as Alzheimer's Disease and progressive supranuclear palsy, vascular dementia such as multi-infarct dementia, encephalitis which include encephalitis periaxialis, viral encephalitis such as epidemic encephalitis, Japanese Encephalitis, St. Louis Encephalitis, tick-borne encephalitis and West Nile Fever, acute disseminated encephalomyelitis, meningoencephalitis such as uveomeningoencephalitic syndrome, Postencephalitic Parkinson Disease and subacute sclerosing panencephalitis, encephalomalacia such as periventricular leukomalacia, epilepsy such as generalized epilepsy which includes infantile spasms, absence epilepsy, myoclonic epilepsy which includes MERRF Syndrome, tonic-clonic epilepsy, partial epilepsy such as complex partial epilepsy, frontal lobe epilepsy and temporal lobe epilepsy, post-traumatic epilepsy, status epilepticus such as Epilepsia Partialis Continua, and Hallervorden-Spatz Syndrome.

Additional neurologic diseases which can be treated or detected with polynucleotides, polypeptides, agonists, and/or antagonists of the present invention include hydrocephalus such as Dandy-Walker Syndrome and normal pressure hydrocephalus, hypothalamic diseases such as hypothalamic neoplasms, cerebral malaria, narcolepsy which includes cataplexy, bulbar poliomyelitis, cerebri pseudotumor, Rett Syndrome, Reye's Syndrome, thalamic diseases, cerebral toxoplasmosis, intracranial tuberculoma and Zellweger Syndrome, central nervous system infections such as AIDS Dementia Complex, Brain Abscess, subdural empyema, encephalomyelitis such as Equine Encephalomyelitis, Venezuelan Equine Encephalomyelitis, Necrotizing Hemorrhagic Encephalomyelitis, Visna, and cerebral malaria.

Additional neurologic diseases which can be treated or detected with polynucleotides, polypeptides, agonists, and/or antagonists of the present invention include meningitis such as arachnoiditis, aseptic meningtitis such as viral meningtitis which includes lymphocytic choriomeningitis, Bacterial meningtitis which includes Haemophilus Meningtitis, Listeria Meningtitis, Meningococcal Meningtitis such as Waterhouse-Friderichsen Syndrome, Pneumococcal Meningtitis and meningeal tuberculosis, fungal meningitis such as Cryptococcal Meningtitis, subdural effusion, meningoencephalitis such as uvemeningoencephalitic syndrome, myelitis such as transverse myelitis, neurosyphilis such as tabes dorsalis, poliomyelitis which includes bulbar poliomyelitis and post-poliomyelitis syndrome, prion diseases (such as Creutzfeldt-Jakob Syndrome, Bovine Spongiform Encephalopathy, Gerstmann-Straussler Syndrome, Kuru, Scrapie), and cerebral toxoplasmosis.

Additional neurologic diseases which can be treated or detected with polynucleotides, polypeptides, agonists, and/or antagonists of the present invention include central nervous system neoplasms such as brain neoplasms that include cerebellar neoplasms such as infratentorial neoplasms, cerebral ventricle neoplasms such as choroid plexus neoplasms, hypothalamic neoplasms and supratentorial neoplasms, meningeal neoplasms, spinal cord neoplasms which include epidural neoplasms, demyelinating diseases such as Canavan Diseases, diffuse cerebral sceloris which includes adrenoleukodystrophy, encephalitis periaxialis, globoid cell leukodystrophy, diffuse cerebral sclerosis such as metachromatic leukodystrophy, allergic encephalomyelitis, necrotizing hemorrhagic encephalomyelitis, progressive multifocal leukoencephalopathy, multiple sclerosis, central pontine myelinolysis, transverse myelitis, neuromyelitis optica, Scrapie, Swayback, Chronic Fatigue Syndrome, Visna, High Pressure Nervous Syndrome, Meningism, spinal cord diseases such as amyotonia congenita, amyotrophic lateral sclerosis, spinal muscular atrophy such as Werdnig-Hoffmann Disease, spinal cord compression, spinal cord neoplasms such as epidural neoplasms, syringomyelia, Tabes Dorsalis, Stiff-Man Syndrome, mental retardation such as Angelman Syndrome, Cri-du-Chat Syndrome, De Lange's Syndrome, Down Syndrome, Gangliosidoses such as gangliosidoses G(M1), Sandhoff Disease, Tay-Sachs Disease, Hartnup Disease, homocystinuria, Laurence-Moon-Biedl Syndrome, Lesch-Nyhan Syndrome, Maple Syrup Urine Disease, mucolipidosis such as fucosidosis, neuronal ceroid-lipofuscinosis, oculocerebrorenal syndrome, phenylketonuria such as maternal phenylketonuria, Prader-Willi Syndrome, Rett Syndrome, Rubinstein-Taybi Syndrome, Tuberous Sclerosis, WAGR Syndrome, nervous system abnormalities such as holoprosencephaly, neural tube defects such as anencephaly which includes hydrangencephaly, Arnold-Chain Deformity, encephalocele, meningocele, meningomyelocele, spinal dysraphism such as spina bifida cystica and spina bifida occulta.

Additional neurologic diseases which can be treated or detected with polynucleotides, polypeptides, agonists, and/or antagonists of the present invention include hereditary motor and sensory neuropathies which include Charcot-Marie Disease, Hereditary optic atrophy, Refsum's Disease, hereditary spastic paraplegia, Werdnig-Hoffmann Disease, Hereditary, Sensory and Autonomic Neuropathies such as Congenital Analgesia and Familial Dysautonomia, Neurologic manifestations (such as agnosia that include Gerstmann's Syndrome, Amnesia such as retrograde amnesia, apraxia, neurogenic bladder, cataplexy, communicative disorders such as hearing disorders that includes deafness, partial hearing loss, loudness recruitment and tinnitus, language disorders such as aphasia which include agraphia, anomia, broca aphasia, and Wernicke Aphasia, Dyslexia such as Acquired Dyslexia, language development disorders, speech disorders such as aphasia which includes anomia, broca aphasia and Wernicke Aphasia, articulation disorders, communicative disorders such as speech disorders which include dysarthria, echolalia, mutism and stuttering, voice disorders such as aphonia and hoarseness, decerebrate state, delirium, fasciculation, hallucinations, meningism, movement disorders such as angelman syndrome, ataxia, athetosis, chorea, dystonia, hypokinesia, muscle hypotonia, myoclonus, tic, torticollis and tremor, muscle hypertonia such as muscle rigidity such as stiff-man syndrome, muscle spasticity, paralysis such as facial paralysis which includes Herpes Zoster Oticus, Gastroparesis, Hemiplegia, opthalmoplegia such as diplopia, Duane's Syndrome, Horner's Syndrome, Chronic progressive external opthalmoplegia such as Kearns Syndrome, Bulbar Paralysis, Tropical Spastic Paraparesis, Paraplegia such as Brown-Sequard Syndrome, quadriplegia, respiratory paralysis and vocal cord paralysis, paresis, phantom limb, taste disorders such as ageusia and dysgeusia, vision disorders such as amblyopia, blindness, color vision defects, diplopia, hemianopsia, scotoma and subnormal vision, sleep disorders such as hypersomnia which includes Kleine-Levin Syndrome, insomnia, and somnambulism, spasm such as trismus, unconsciousness such as coma, persistent vegetative state and syncope and vertigo, neuromuscular diseases such as amyotonia congenita, amyotrophic lateral sclerosis, Lambert-Eaton Myasthenic Syndrome, motor neuron disease, muscular atrophy such as spinal muscular atrophy, Charcot-Marie Disease and Werdnig-Hoffmann Disease, Postpoliomyelitis Syndrome, Muscular Dystrophy, Myasthenia Gravis, Myotonia Atrophica, Myotonia Confenita, Nemaline Myopathy, Familial Periodic Paralysis, Multiplex Paramyloclonus, Tropical Spastic Paraparesis and Stiff-Man Syndrome, peripheral nervous system diseases such as acrodynia, amyloid neuropathies, autonomic nervous system diseases such as Adie's Syndrome, Barre-Lieou Syndrome, Familial Dysautonomia, Horner's Syndrome, Reflex Sympathetic Dystrophy and Shy-Drager Syndrome, Cranial Nerve Diseases such as Acoustic Nerve Diseases such as Acoustic Neuroma which includes Neurofibromatosis 2, Facial Nerve Diseases such as Facial Neuralgia,Melkersson-Rosenthal Syndrome, ocular motility disorders which includes amblyopia, nystagmus, oculomotor nerve paralysis, opthalmoplegia such as Duane's Syndrome, Horner's Syndrome, Chronic Progressive External Opthalmoplegia which includes Kearns Syndrome, Strabismus such as Esotropia and Exotropia, Oculomotor Nerve Paralysis, Optic Nerve Diseases such as Optic Atrophy which includes Hereditary Optic Atrophy, Optic Disk Drusen, Optic Neuritis such as Neuromyelitis Optica, Papilledema, Trigeminal Neuralgia, Vocal Cord Paralysis, Demyelinating Diseases such as Neuromyelitis Optica and Swayback, and Diabetic neuropathies such as diabetic foot.

Additional neurologic diseases which can be treated or detected with polynucleotides, polypeptides, agonists, and/or antagonists of the present invention include nerve compression syndromes such as carpal tunnel syndrome, tarsal tunnel syndrome, thoracic outlet syndrome such as cervical rib syndrome, ulnar nerve compression syndrome, neuralgia such as causalgia, cervico-brachial neuralgia, facial neuralgia and trigeminal neuralgia, neuritis such as experimental allergic neuritis, optic neuritis, polyneuritis, polyradiculoneuritis and radiculities such as polyradiculitis, hereditary motor and sensory neuropathies such as Charcot-Marie Disease, Hereditary Optic Atrophy, Refsum's Disease, Hereditary Spastic Paraplegia and Werdnig-Hoffmann Disease, Hereditary Sensory and Autonomic Neuropathies which include Congenital Analgesia and Familial Dysautonomia, POEMS Syndrome, Sciatica, Gustatory Sweating and Tetany).

Endocrine Disorders

Polynucleotides or polypeptides, or agonists or antagonists of the present invention, may be used to treat, prevent, diagnose, and/or prognose disorders and/or diseases related to hormone imbalance, and/or disorders or diseases of the endocrine system.

Hormones secreted by the glands of the endocrine system control physical growth, sexual function, metabolism, and other functions. Disorders may be classified in two ways: disturbances in the production of hormones, and the inability of tissues to respond to hormones. The etiology of these hormone imbalance or endocrine system diseases, disorders or conditions may be genetic, somatic, such as cancer and some autoimmune diseases, acquired (e.g., by chemotherapy, injury or toxins), or infectious. Moreover, polynucleotides, polypeptides, antibodies, and/or agonists or antagonists of the present invention can be used as a marker or detector of a particular disease or disorder related to the endocrine system and/or hormone imbalance.

Endocrine system and/or hormone imbalance and/or diseases encompass disorders of uterine motility including, but not limited to: complications with pregnancy and labor (e.g., pre-term labor, post-term pregnancy, spontaneous abortion, and slow or stopped labor); and disorders and/or diseases of the menstrual cycle (e.g., dysmenorrhea and endometriosis).

Endocrine system and/or hormone imbalance disorders and/or diseases include disorders and/or diseases of the pancreas, such as, for example, diabetes mellitus, diabetes insipidus, congenital pancreatic agenesis, pheochromocytoma—islet cell tumor syndrome; disorders and/or diseases of the adrenal glands such as, for example, Addison's Disease, corticosteroid deficiency, virilizing disease, hirsutism, Cushing's Syndrome, hyperaldosteronism, pheochromocytoma; disorders and/or diseases of the pituitary gland, such as, for example, hyperpituitarism, hypopituitarism, pituitary dwarfism, pituitary adenoma, panhypopituitarism, acromegaly, gigantism; disorders and/or diseases of the thyroid, including but not limited to, hyperthyroidism, hypothyroidism, Plummer's disease, Graves' disease (toxic diffuse goiter), toxic nodular goiter, thyroiditis (Hashimoto's thyroiditis, subacute granulomatous thyroiditis, and silent lymphocytic thyroiditis), Pendred's syndrome, myxedema, cretinism, thyrotoxicosis, thyroid hormone coupling defect, thymic aplasia, Hurthle cell tumours of the thyroid, thyroid cancer, thyroid carcinoma, Medullary thyroid carcinoma; disorders and/or diseases of the parathyroid, such as, for example, hyperparathyroidism, hypoparathyroidism; disorders and/or diseases of the hypothalamus.

In specific embodiments, the polynucleotides and/or polypeptides corresponding to this gene and/or agonists or antagonists of those polypeptides (including antibodies) as well as fragments and variants of those polynucleotides, polypeptides, agonists and antagonists, may be used to diagnose, prognose, treat, prevent, or ameliorate diseases and disorders associated with aberrant glucose metabolism or glucose uptake into cells.

In a specific embodiment, the polynucleotides and/or polypeptides corresponding to this gene and/or agonists and/or antagonists thereof may be used to diagnose, prognose, treat, prevent, and/or ameliorate type I diabetes mellitus (insulin dependent diabetes mellitus, IDDM).

In another embodiment, the polynucleotides and/or polypeptides corresponding to this gene and/or agonists and/or antagonists thereof may be used to diagnose, prognose, treat, prevent, and/or ameliorate type II diabetes mellitus (insulin resistant diabetes mellitus).

Additionally, in other embodiments, the polynucleotides and/or polypeptides corresponding to this gene and/or antagonists thereof (especially neutralizing or antagonistic antibodies) may be used to diagnose, prognose, treat, prevent, and/or ameliorate conditions associated with (type I or type II) diabetes mellitus, including, but not limited to, diabetic ketoacidosis, diabetic coma, nonketotic hyperglycemic-hyperosmolar coma, seizures, mental confusion, drowsiness, cardiovascular disease (e.g., heart disease, atherosclerosis, microvascular disease, hypertension, stroke, and other diseases and disorders as described in the "Cardiovascular Disorders" section), dyslipidemia, kidney disease (e.g., renal failure, nephropathy other diseases and disorders as described in the "Renal Disorders" section), nerve damage, neuropathy, vision impairment (e.g., diabetic retinopathy and blindness), ulcers and impaired wound healing, infections (e.g., infectious diseases and disorders as described in the "Infectious Diseases" section, especially of the urinary tract and skin), carpal tunnel syndrome and Dupuytren's contracture.

In other embodiments, the polynucleotides and/or polypeptides corresponding to this gene and/or agonists or antagonists thereof are administered to an animal, preferably a mammal, and most preferably a human, in order to regulate the animal's weight. In specific embodiments the polynucleotides and/or polypeptides corresponding to this gene and/or agonists or antagonists thereof are administered to an animal, preferably a mammal, and most preferably a human, in order to control the animal's weight by modulating a biochemical pathway involving insulin. In still other embodiments the polynucleotides and/or polypeptides corresponding to this gene and/or agonists or antagonists thereof are administered to an animal, preferably a mammal, and most preferably a human, in order to control the animal's weight by modulating a biochemical pathway involving insulin-like growth factor.

In addition, endocrine system and/or hormone imbalance disorders and/or diseases may also include disorders and/or diseases of the testes or ovaries, including cancer. Other disorders and/or diseases of the testes or ovaries further include, for example, ovarian cancer, polycystic ovary syndrome, Klinefelter's syndrome, vanishing testes syndrome (bilateral anorchia), congenital absence of Leydig's cells, cryptorchidism, Noonan's syndrome, myotonic dystrophy, capillary haemangioma of the testis (benign), neoplasias of the testis and neo-testis.

Moreover, endocrine system and/or hormone imbalance disorders and/or diseases may also include disorders and/or diseases such as, for example, polyglandular deficiency syndromes, pheochromocytoma, neuroblastoma, multiple Endocrine neoplasia, and disorders and/or cancers of endocrine tissues.

In another embodiment, a polypeptide of the invention, or polynucleotides, antibodies, agonists, or antagonists corresponding to that polypeptide, may be used to diagnose, prognose, prevent, and/or treat endocrine diseases and/or disorders associated with the tissue(s) in which the polypeptide of the invention is expressed, including one, two, three, four, five, or more tissues disclosed in Table 1A, column 8 (Tissue Distribution Library Code).

Reproductive System Disorders

The polynucleotides or polypeptides, or agonists or antagonists of the invention may be used for the diagnosis, treatment, or prevention of diseases and/or disorders of the reproductive system. Reproductive system disorders that can be treated by the compositions of the invention, include, but are not limited to, reproductive system injuries, infections, neoplastic disorders, congenital defects, and diseases or disorders which result in infertility, complications with pregnancy, labor, or parturition, and postpartum difficulties.

Reproductive system disorders and/or diseases include diseases and/or disorders of the testes, including testicular atrophy, testicular feminization, cryptorchism (unilateral and bilateral), anorchia, ectopic testis, epididymitis and orchitis (typically resulting from infections such as, for example, gonorrhea, mumps, tuberculosis, and syphilis), testicular torsion, vasitis nodosa, germ cell tumors (e.g., seminomas, embryonal cell carcinomas, teratocarcinomas, choriocarcinomas, yolk sac tumors, and teratomas), stromal tumors (e.g., Leydig cell tumors), hydrocele, hematocele, varicocele, spermatocele, inguinal hernia, and disorders of sperm production (e.g., immotile cilia syndrome, aspermia, asthenozoospermia, azoospermia, oligospermia, and teratozoospermia).

Reproductive system disorders also include disorders of the prostate gland, such as acute non-bacterial prostatitis, chronic non-bacterial prostatitis, acute bacterial prostatitis, chronic bacterial prostatitis, prostatodystonia, prostatosis, granulomatous prostatitis, malacoplakia, benign prostatic hypertrophy or hyperplasia, and prostate neoplastic disorders, including adenocarcinomas, transitional cell carcinomas, ductal carcinomas, and squamous cell carcinomas.

Additionally, the compositions of the invention may be useful in the diagnosis, treatment, and/or prevention of disorders or diseases of the penis and urethra, including inflammatory disorders, such as balanoposthitis, balanitis xerotica obliterans, phimosis, paraphimosis, syphilis, herpes simplex virus, gonorrhea, non-gonococcal urethritis, chlamydia, mycoplasma, trichomonas, HIV, AIDS, Reiter's syndrome, condyloma acuminatum, condyloma latum, and pearly penile papules; urethral abnormalities, such as hypospadias, epispadias, and phimosis; premalignant lesions, including Erythroplasia of Queyrat, Bowen's disease, Bowenoid paplosis, giant condyloma of Buscke-Lowenstein, and varrucous carcinoma; penile cancers, including squamous cell carcinomas, carcinoma in situ, verrucous carcinoma, and disseminated penile carcinoma; urethral neoplastic disorders, including penile urethral carcinoma, bulbomembranous urethral carcinoma, and prostatic urethral carcinoma; and erectile disorders, such as priapism, Peyronie's disease, erectile dysfunction, and impotence.

Moreover, diseases and/or disorders of the vas deferens include vasculititis and CBAVD (congenital bilateral absence of the vas deferens); additionally, the polynucleotides, polypeptides, and agonists or antagonists of the present invention may be used in the diagnosis, treatment, and/or prevention of diseases and/or disorders of the seminal vesicles, including hydatid disease, congenital chloride diarrhea, and polycystic kidney disease.

Other disorders and/or diseases of the male reproductive system include, for example, Klinefelter's syndrome, Young's syndrome, premature ejaculation, diabetes mellitus, cystic fibrosis, Kartagener's syndrome, high fever, multiple sclerosis, and gynecomastia.

Further, the polynucleotides, polypeptides, and agonists or antagonists of the present invention may be used in the diagnosis, treatment, and/or prevention of diseases and/or disorders of the vagina and vulva, including bacterial vaginosis, candida vaginitis, herpes simplex virus, chancroid, granuloma inguinale, lymphogranuloma venereum, scabies, human papillomavirus, vaginal trauma, vulvar trauma, adenosis, chlamydia vaginitis, gonorrhea, trichomonas vaginitis, condyloma acuminatum, syphilis, molluscum contagiosum, atrophic vaginitis, Paget's disease, lichen sclerosus, lichen planus, vulvodynia, toxic shock syndrome, vaginismus, vulvovaginitis, vulvar vestibulitis, and neoplastic disorders, such as squamous cell hyperplasia, clear cell carcinoma, basal cell carcinoma, melanomas, cancer of Bartholin's gland, and vulvar intraepithelial neoplasia.

Disorders and/or diseases of the uterus include dysmenorrhea, retroverted uterus, endometriosis, fibroids, adenomyosis, anovulatory bleeding, amenorrhea, Cushing's syndrome, hydatidiform moles, Asherman's syndrome, premature menopause, precocious puberty, uterine polyps, dysfunctional uterine bleeding (e.g., due to aberrant hormonal signals), and neoplastic disorders, such as adenocarcinomas, keiomyosarcomas, and sarcomas. Additionally, the polypeptides, polynucleotides, or agonists or antagonists of the invention may be useful as a marker or detector of, as well as in the diagnosis, treatment, and/or prevention of congenital uterine abnormalities, such as bicornuate uterus, septate uterus, simple unicornuate uterus, unicornuate uterus with a noncavitary rudimentary horn, unicornuate uterus with a non-communicating cavitary rudimentary horn, unicornuate uterus with a communicating cavitary horn, arcuate uterus, uterine didelfus, and T-shaped uterus.

Ovarian diseases and/or disorders include anovulation, polycystic ovary syndrome (Stein-Leventhal syndrome), ovarian cysts, ovarian hypofunction, ovarian insensitivity to gonadotropins, ovarian overproduction of androgens, right ovarian vein syndrome, amenorrhea, hirutism, and ovarian cancer (including, but not limited to, primary and secondary cancerous growth, Sertoli-Leydig tumors, endometriod carcinoma of the ovary, ovarian papillary serous adenocarcinoma, ovarian mucinous adenocarcinoma, and Ovarian Krukenberg tumors).

Cervical diseases and/or disorders include cervicitis, chronic cervicitis, mucopurulent cervicitis, cervical dysplasia, cervical polyps, Nabothian cysts, cervical erosion, cervical incompetence, and cervical neoplasms (including, for example, cervical carcinoma, squamous metaplasia, squamous cell carcinoma, adenosquamous cell neoplasia, and columnar cell neoplasia).

Additionally, diseases and/or disorders of the reproductive system include disorders and/or diseases of pregnancy, including miscarriage and stillbirth, such as early abortion, late abortion, spontaneous abortion, induced abortion, therapeutic abortion, threatened abortion, missed abortion, incomplete abortion, complete abortion, habitual abortion, missed abortion, and septic abortion; ectopic pregnancy, anemia, Rh incompatibility, vaginal bleeding during pregnancy, gestational diabetes, intrauterine growth retardation, polyhydramnios, HELLP syndrome, abruptio placentae, placenta previa, hyperemesis, preeclampsia, eclampsia, herpes gestationis, and urticaria of pregnancy. Additionally, the polynucleotides, polypeptides, and agonists or antagonists of the present invention may be used in the diagnosis, treatment, and/or prevention of diseases that can complicate pregnancy, including heart disease, heart failure, rheumatic heart disease, congenital heart disease, mitral valve prolapse, high blood pressure, anemia, kidney disease, infectious disease (e.g., rubella, cytomegalovirus, toxoplasmosis, infectious hepatitis, chlamydia, HIV, AIDS, and genital herpes), diabetes mellitus, Graves' disease, thyroiditis, hypothyroidism, Hashimoto's thyroiditis, chronic active hepatitis, cirrhosis of the liver, primary biliary cirrhosis, asthma, systemic lupus eryematosis, rheumatoid arthritis, myasthenia gravis, idiopathic thrombocytopenic purpura, appendicitis, ovarian cysts, gallbladder disorders, and obstruction of the intestine.

Complications associated with labor and parturition include premature rupture of the membranes, pre-term labor, post-term pregnancy, postmaturity, labor that progresses too slowly, fetal distress (e.g., abnormal heart rate (fetal or maternal), breathing problems, and abnormal fetal position), shoulder dystocia, prolapsed umbilical cord, amniotic fluid embolism, and aberrant uterine bleeding.

Further, diseases and/or disorders of the postdelivery period, including endometritis, myometritis, parametritis, peritonitis, pelvic thrombophlebitis, pulmonary embolism, endotoxemia, pyelonephritis, saphenous thrombophlebitis, mastitis, cystitis, postpartum hemorrhage, and inverted uterus.

Other disorders and/or diseases of the female reproductive system that may be diagnosed, treated, and/or prevented by the polynucleotides, polypeptides, and agonists or antagonists of the present invention include, for example, Turner's syndrome, pseudohermaphroditism, premenstrual syndrome, pelvic inflammatory disease, pelvic congestion (vascular engorgement), frigidity, anorgasmia, dyspareunia, ruptured fallopian tube, and Mittelschmerz.

Infectious Disease

Polynucleotides or polypeptides, as well as agonists or antagonists of the present invention can be used to treat or detect infectious agents. For example, by increasing the immune response, particularly increasing the proliferation and differentiation of B and/or T cells, infectious diseases may be treated. The immune response may be increased by either enhancing an existing immune response, or by initiating a new immune response. Alternatively, polynucleotides or polypeptides, as well as agonists or antagonists of the present invention may also directly inhibit the infectious agent, without necessarily eliciting an immune response.

Viruses are one example of an infectious agent that can cause disease or symptoms that can be treated or detected by a polynucleotide or polypeptide and/or agonist or antagonist of the present invention. Examples of viruses, include, but are not limited to Examples of viruses, include, but are not limited to the following DNA and RNA viruses and viral families: Arbovirus, Adenoviridae, Arenaviridae, Arterivirus, Birnaviridae, Bunyaviridae, Caliciviridae, Circoviridae, Coronaviridae, Dengue, EBV, HIV, Flaviviridae, Hepadnaviridae (Hepatitis), Herpesviridae (such as, Cytomegalovirus, Herpes Simplex, Herpes Zoster), Mononegavirus (e.g., Paramyxoviridae, Morbillivirus, Rhabdoviridae), Orthomyxoviridae (e.g., Influenza A, Influenza B, and parainfluenza), Papiloma virus, Papovaviridae, Parvoviridae, Picornaviridae, Poxyiridae (such as Smallpox or Vaccinia), Reoviridae (e.g., Rotavirus), Retroviridae (HTLV-I, HTLV-II, Lentivirus), and Togaviridae (e.g., Rubivirus). Viruses falling within these families can cause a variety of diseases or symptoms, including, but not limited to: arthritis, bronchiollitis, respiratory syncytial virus, encephalitis, eye infections (e.g., conjunctivitis, keratitis), chronic fatigue syndrome, hepatitis (A, B, C, E, Chronic Active, Delta), Japanese B encephalitis, Junin, Chikungunya, Rift Valley fever, yellow fever, meningitis, opportunistic infections (e.g., AIDS), pneumonia, Burkitt's Lymphoma, chickenpox, hemorrhagic fever, Measles, Mumps, Parainfluenza, Rabies, the common cold, Polio, leukemia, Rubella, sexually transmitted diseases, skin diseases (e.g., Kaposi's, warts), and viremia. polynucleotides or polypeptides, or agonists or antagonists of the invention, can be used to treat or detect any of these symptoms or diseases. In specific embodiments, polynucleotides, polypeptides, or agonists or antagonists of the invention are used to treat: meningitis, Dengue, EBV, and/or hepatitis (e.g., hepatitis B). In an additional specific embodiment polynucleotides, polypeptides, or agonists or antagonists of the invention are used to treat patients nonresponsive to one or more other commercially available hepatitis vaccines. In a further specific embodiment polynucleotides, polypeptides, or agonists or antagonists of the invention are used to treat AIDS.

Similarly, bacterial and fungal agents that can cause disease or symptoms and that can be treated or detected by a polynucleotide or polypeptide and/or agonist or antagonist of the present invention include, but not limited to, the following Gram-Negative and Gram-positive bacteria, bacterial families, and fungi: *Actinomyces* (e.g., *Norcardia*), *Acinetobacter, Cryptococcus neoformans, Aspergillus*, Bacillaceae (e.g., *Bacillus anthrasis*), *Bacteroides* (e.g., *Bacteroides fragilis*), Blastomycosis, *Bordetella, Borrelia* (e.g., *Borrelia burgdorferi*), *Brucella, Candidia, Campylobacter, Chlamydia, Clostridium* (e.g., *Clostridium botulinum, Clostridium dificile, Clostridium perfringens, Clostridium tetani*), *Coccidioides, Corynebacterium* (e.g., *Corynebacterium diptheriae*), *Cryptococcus, Dermatocycoses, E. coli* (e.g., Enterotoxigenic *E. coli* and Enterohemorrhagic *E. coli*), *Enterobacter* (e.g. *Enterobacter aerogenes*), Enterobacteriaceae (*Klebsiella, Salmonella* (e.g., *Salmonella typhi, Salmonella enteritidis, Salmonella typhi*), *Serratia, Yersinia, Shigella*), *Erysipelothrix, Haemophilus* (e.g., *Haemophilus influenza* type B), *Helicobacter, Legionella* (e.g., *Legionella pneumophila*), *Leptospira, Listeria* (e.g., *Listeria monocytogenes*), *Mycoplasma, Mycobacterium* (e.g., *Mycobacterium leprae* and *Mycobacterium tuberculosis*), *Vibrio* (e.g., *Vibrio cholerae*), Neisseriaceae (e.g., *Neisseria gonorrhea, Neisseria meningitidis*), Pasteurellacea, *Proteus, Pseudomonas* (e.g., *Pseudomonas aeruginosa*), Rickettsiaceae, Spirochetes (e.g., *Treponema* spp., *Leptospira* spp., *Borrelia* spp.), *Shigella* spp., *Staphylococcus* (e.g., *Staphylococcus aureus*), *Meningiococcus, Pneumococcus* and *Streptococcus* (e.g., *Streptococcus pneumoniae* and Groups A, B, and C Streptococci), and Ureaplasmas. These bacterial, parasitic, and fungal families can cause diseases or symptoms, including, but not limited to: antibiotic-resistant infections, bacteremia, endocarditis, septicemia, eye infections (e.g., conjunctivitis), uveitis, tuberculosis, gingivitis, bacterial diarrhea, opportunistic infections (e.g., AIDS related infections), paronychia, prosthesis-related infections, dental caries, Reiter's Disease, respiratory tract infections, such as Whooping Cough or Empyema, sepsis, Lyme Disease, Cat-Scratch Disease, dysentery, paratyphoid fever, food poisoning, Legionella disease, chronic and acute inflammation, erythema, yeast infections, typhoid, pneumonia, gonorrhea, meningitis (e.g., mengitis types A and B), chlamydia, syphillis, diphtheria, leprosy, brucellosis, peptic ulcers, anthrax, spontaneous abortions, birth defects, pneumonia, lung infections, ear infections, deafness, blindness, lethargy, malaise, vomiting, chronic diarrhea, Crohn's disease, colitis, vaginosis, sterility, pelvic inflammatory diseases, candidiasis, paratuberculosis, tuberculosis, lupus, botulism, gangrene, tetanus, impetigo, Rheumatic Fever, Scarlet Fever, sexually transmitted diseases, skin diseases (e.g., cellulitis, dermatocycoses), toxemia, urinary tract infections, wound infections, noscomial infections. Polynucleotides or polypeptides, agonists or antagonists of the invention, can be used to treat or detect any of these symptoms or diseases. In specific embodiments, polynucleotides, polypeptides, agonists or antagonists of the invention are used to treat: tetanus, diptheria, botulism, and/or meningitis type B.

Moreover, parasitic agents causing disease or symptoms that can be treated, prevented, and/or diagnosed by a polynucleotide or polypeptide and/or agonist or antagonist of the present invention include, but not limited to, the following families or class: Amebiasis, Babesiosis, Coccidiosis, Cryptosporidiosis, Dientamoebiasis, Dourine, Ectoparasitic, Giardias, Helminthiasis, Leishmaniasis, Schistisoma, Theileriasis, Toxoplasmosis, Trypanosomiasis, and Trichomonas and Sporozoans (e.g., *Plasmodium virax, Plasmodium falciparium, Plasmodium malariae* and *Plasmodium ovale*). These parasites can cause a variety of diseases or symptoms, including, but not limited to: Scabies, Trombiculiasis, eye infections, intestinal disease (e.g., dysentery, giardiasis), liver disease, lung disease, opportunistic infections (e.g., AIDS related), malaria, pregnancy complications, and toxoplasmosis. polynucleotides or polypeptides, or agonists or antagonists of the invention, can be used to treat, prevent, and/or diagnose any of these symptoms or diseases. In specific embodiments, polynucleotides, polypeptides, or agonists or antagonists of the invention are used to treat, prevent, and/or diagnose malaria.

Polynucleotides or polypeptides, as well as agonists or antagonists of the present invention of the present invention could either be by administering an effective amount of a polypeptide to the patient, or by removing cells from the patient, supplying the cells with a polynucleotide of the present invention, and returning the engineered cells to the patient (ex vivo therapy). Moreover, the polypeptide or polynucleotide of the present invention can be used as an antigen in a vaccine to raise an immune response against infectious disease.

Regeneration

Polynucleotides or polypeptides, as well as agonists or antagonists of the present invention can be used to differentiate, proliferate, and attract cells, leading to the regeneration of tissues. (See, Science 276:59-87 (1997)). The regeneration of tissues could be used to repair, replace, or protect tissue damaged by congenital defects, trauma (wounds, burns, incisions, or ulcers), age, disease (e.g. osteoporosis, osteocarthritis, periodontal disease, liver failure), surgery, including cosmetic plastic surgery, fibrosis, reperfusion injury, or systemic cytokine damage.

Tissues that could be regenerated using the present invention include organs (e.g., pancreas, liver, intestine, kidney, skin, endothelium), muscle (smooth, skeletal or cardiac), vasculature (including vascular and lymphatics), nervous, hematopoietic, and skeletal (bone, cartilage, tendon, and ligament) tissue. Preferably, regeneration occurs without or decreased scarring. Regeneration also may include angiogenesis.

Moreover, polynucleotides or polypeptides, as well as agonists or antagonists of the present invention, may increase regeneration of tissues difficult to heal. For example, increased tendon/ligament regeneration would quicken recovery time after damage. Polynucleotides or polypeptides, as well as agonists or antagonists of the present invention could also be used prophylactically in an effort to avoid damage. Specific diseases that could be treated include of tendinitis, carpal tunnel syndrome, and other tendon or ligament defects. A further example of tissue regeneration of non-healing wounds includes pressure ulcers, ulcers associated with vascular insufficiency, surgical, and traumatic wounds.

Similarly, nerve and brain tissue could also be regenerated by using polynucleotides or polypeptides, as well as agonists or antagonists of the present invention, to proliferate and differentiate nerve cells. Diseases that could be treated using this method include central and peripheral nervous system diseases, neuropathies, or mechanical and traumatic disorders (e.g., spinal cord disorders, head trauma, cerebrovascular disease, and stoke). Specifically, diseases associated with peripheral nerve injuries, peripheral neuropathy (e.g., resulting from chemotherapy or other medical therapies), localized neuropathies, and central nervous system diseases (e.g., Alzheimer's disease, Parkinson's disease, Huntington's disease, amyotrophic lateral sclerosis, and Shy-Drager syndrome), could all be treated using the polynucleotides or polypeptides, as well as agonists or antagonists of the present invention.

Gastrointestinal Disorders

Polynucleotides or polypeptides, or agonists or antagonists of the present invention, may be used to treat, prevent, diagnose, and/or prognose gastrointestinal disorders, including inflammatory diseases and/or conditions, infections, cancers (e.g., intestinal neoplasms (carcinoid tumor of the small intestine, non-Hodgkin's lymphoma of the small intestine, small bowl lymphoma)), and ulcers, such as peptic ulcers.

Gastrointestinal disorders include dysphagia, odynophagia, inflammation of the esophagus, peptic esophagitis, gastric reflux, submucosal fibrosis and stricturing, Mallory-Weiss lesions, leiomyomas, lipomas, epidermal cancers, adeoncarcinomas, gastric retention disorders, gastroenteritis, gastric atrophy, gastric/stomach cancers, polyps of the stomach, autoimmune disorders such as pernicious anemia, pyloric stenosis, gastritis (bacterial, viral, eosinophilic, stress-induced, chronic erosive, atrophic, plasma cell, and Menetrier's), and peritoneal diseases (e.g., chyloperioneum, hemoperitoneum, mesenteric cyst, mesenteric lymphadenitis, mesenteric vascular occlusion, panniculitis, neoplasms, peritonitis, pneumoperitoneum, bubphrenic abscess,).

Gastrointestinal disorders also include disorders associated with the small intestine, such as malabsorption syndromes, distension, irritable bowel syndrome, sugar intolerance, celiac disease, duodenal ulcers, duodenitis, tropical sprue, Whipple's disease, intestinal lymphangiectasia, Crohn's disease, appendicitis, obstructions of the ileum, Meckel's diverticulum, multiple diverticula, failure of complete rotation of the small and large intestine, lymphoma, and bacterial and parasitic diseases (such as Traveler's diarrhea, typhoid and paratyphoid, cholera, infection by Roundworms (*Ascariasis lumbricoides*), Hookworms (*Ancylostoma duodenale*), Threadworms (*Enterobius vermicularis*), Tapeworms (*Taenia saginata, Echinococcus granulosus, Diphyllobothrium* spp., and *T. solium*).

Liver diseases and/or disorders include intrahepatic cholestasis (alagille syndrome, biliary liver cirrhosis), fatty liver (alcoholic fatty liver, reye syndrome), hepatic vein thrombosis, hepatolentricular degeneration, hepatomegaly, hepatopulmonary syndrome, hepatorenal syndrome, portal hypertension (esophageal and gastric varices), liver abscess (amebic liver abscess), liver cirrhosis (alcoholic, biliary and experimental), alcoholic liver diseases (fatty liver, hepatitis, cirrhosis), parasitic (hepatic echinococcosis, fascioliasis, amebic liver abscess), jaundice (hemolytic, hepatocellular, and cholestatic), cholestasis, portal hypertension, liver enlargement, ascites, hepatitis (alcoholic hepatitis, animal hepatitis, chronic hepatitis (autoimmune, hepatitis B, hepatitis C, hepatitis D, drug induced), toxic hepatitis, viral human hepatitis (hepatitis A, hepatitis B, hepatitis C, hepatitis D, hepatitis E), Wilson's disease, granulomatous hepatitis, secondary biliary cirrhosis, hepatic encephalopathy, portal hypertension, varices, hepatic encephalopathy, primary biliary cirrhosis, primary sclerosing cholangitis, hepatocellular adenoma, hemangiomas, bile stones, liver failure (hepatic encephalopathy, acute liver failure), and liver neoplasms (angiomyolipoma, calcified liver metastases, cystic liver metastases, epithelial tumors, fibrolamellar hepatocarcinoma, focal nodular hyperplasia, hepatic adenoma, hepatobiliary cystadenoma, hepatoblastoma, hepatocellular carcinoma, hepatoma, liver cancer, liver hemangioendothelioma, mesenchymal hamartoma, mesenchymal tumors of liver, nodular regenerative hyperplasia, benign liver tumors (Hepatic cysts [Simple cysts, Polycystic liver disease, Hepatobiliary cystadenoma, Choledochal cyst], Mesenchymal tumors [Mesenchymal hamartoma, Infantile hemangioendothelioma, Hemangioma, Peliosis hepatis, Lipomas, Inflammatory pseudotumor, Miscellaneous], Epithelial tumors [Bile duct epithelium (Bile duct hamartoma, Bile duct adenoma), Hepatocyte (Adenoma, Focal nodular hyperplasia, Nodular regenerative hyperplasia)], malignant liver tumors [hepatocellular, hepatoblastoma, hepatocellular carcinoma, cholangiocellular, cholangiocarcinoma, cystadenocarcinoma, tumors of blood vessels, angiosarcoma, Karposi's sarcoma, hemangioendothelioma, other tumors, embryonal sarcoma, fibrosarcoma, leiomyosarcoma, rhabdomyosarcoma, carcinosarcoma, teratoma, carcinoid, squamous carcinoma, primary lymphoma]), peliosis hepatis, erythrohepatic porphyria, hepatic porphyria (acute intermittent porphyria, porphyria cutanea tarda), Zellweger syndrome).

Pancreatic diseases and/or disorders include acute pancreatitis, chronic pancreatitis (acute necrotizing pancreatitis, alcoholic pancreatitis), neoplasms (adenocarcinoma of the pancreas, cystadenocarcinoma, insulinoma, gastrinoma, and glucagonoma, cystic neoplasms, islet-cell tumors, pancreoblastoma), and other pancreatic diseases (e.g., cystic fibrosis, cyst (pancreatic pseudocyst, pancreatic fistula, insufficiency)).

Gallbladder diseases include gallstones (cholelithiasis and choledocholithiasis), postcholecystectomy syndrome, diverticulosis of the gallbladder, acute cholecystitis, chronic cholecystitis, bile duct tumors, and mucocele.

Diseases and/or disorders of the large intestine include antibiotic-associated colitis, diverticulitis, ulcerative colitis, acquired megacolon, abscesses, fungal and bacterial infections, anorectal disorders (e.g., fissures, hemorrhoids), colonic diseases (colitis, colonic neoplasms [colon cancer, adenomatous colon polyps (e.g., villous adenoma), colon carcinoma, colorectal cancer], colonic diverticulitis, colonic diverticulosis, megacolon [Hirschsprung disease, toxic megacolon]; sigmoid diseases [proctocolitis, sigmoin neoplasms]), constipation, Crohn's disease, diarrhea (infantile diarrhea, dysentery), duodenal diseases (duodenal neoplasms, duodenal obstruction, duodenal ulcer, duodenitis), enteritis (enterocolitis), HIV enteropathy, ileal diseases (ileal neoplasms, ileitis), immunoproliferative small intestinal disease, inflammatory bowel disease (ulcerative colitis, Crohn's disease), intestinal atresia, parasitic diseases (anisakiasis, balantidiasis, blastocystis infections, cryptosporidiosis, dientamoebiasis, amebic dysentery, giardiasis), intestinal fistula (rectal fistula), intestinal neoplasms (cecal neoplasms, colonic neoplasms, duodenal neoplasms, ileal neoplasms, intestinal polyps, jejunal neoplasms, rectal neoplasms), intestinal obstruction (afferent loop syndrome, duodenal obstruction, impacted feces, intestinal pseudo-obstruction [cecal volvulus], intussusception), intestinal perforation, intestinal polyps (colonic polyps, gardner syndrome, peutz-jeghers syndrome), jejunal diseases (jejunal neoplasms), malabsorption syndromes (blind loop syndrome, celiac disease, lactose intolerance, short bowl syndrome, tropical sprue, whipple's disease), mesenteric vascular occlusion, pneumatosis cystoides intestinalis, protein-losing enteropathies (intestinal lymphagiectasis), rectal diseases (anus diseases, fecal incontinence, hemorrhoids, proctitis, rectal fistula, rectal prolapse, rectocele), peptic ulcer (duodenal ulcer, peptic esophagitis, hemorrhage, perforation, stomach ulcer, Zollinger-Ellison syndrome), postgastrectomy syndromes (dumping syndrome), stomach diseases (e.g., achlorhydria, duodenogastric reflux (bile reflux), gastric antral vascular ectasia, gastric fistula, gastric outlet obstruction, gastritis (atrophic or hypertrophic), gastroparesis, stomach dilatation, stomach diverticulum, stomach neoplasms (gastric cancer, gastric polyps, gastric adenocarcinoma, hyperplastic gastric polyp), stomach rupture, stomach ulcer, stomach volvulus), tuberculosis, visceroptosis, vomiting (e.g., hematemesis, hyperemesis gravidarum, postoperative nausea and vomiting) and hemorrhagic colitis.

Further diseases and/or disorders of the gastrointestinal system include biliary tract diseases, such as, gastroschisis, fistula (e.g., biliary fistula, esophageal fistula, gastric fistula, intestinal fistula, pancreatic fistula), neoplasms (e.g., biliary tract neoplasms, esophageal neoplasms, such as adenocarcinoma of the esophagus, esophageal squamous cell carcinoma, gastrointestinal neoplasms, pancreatic neoplasms, such as adenocarcinoma of the pancreas, mucinous cystic neoplasm of the pancreas, pancreatic cystic neoplasms, pancreatoblastoma, and peritoneal neoplasms), esophageal disease (e.g., bullous diseases, candidiasis, glycogenic acanthosis, ulceration, barrett esophagus varices, atresia, cyst, diverticulum (e.g., Zenker's diverticulum), fistula (e.g., tracheoesophageal fistula), motility disorders (e.g., CREST syndrome, deglutition disorders, achalasia, spasm, gastroesophageal reflux), neoplasms, perforation (e.g., Boerhaave syndrome, Mallory-Weiss syndrome), stenosis, esophagitis, diaphragmatic hernia (e.g., hiatal hernia); gastrointestinal diseases, such as, gastroenteritis (e.g., cholera morbus, norwalk virus infection), hemorrhage (e.g., hematemesis, melena, peptic ulcer hemorrhage), stomach neoplasms (gastric cancer, gastric polyps, gastric adenocarcinoma, stomach cancer)), hernia (e.g., congenital diaphragmatic hernia, femoral hernia, inguinal hernia, obturator hernia, umbilical hernia, ventral hernia), and intestinal diseases (e.g., cecal diseases (appendicitis, cecal neoplasms)).

Chemotaxis

Polynucleotides or polypeptides, as well as agonists or antagonists of the present invention may have chemotaxis activity. A chemotaxic molecule attracts or mobilizes cells (e.g., monocytes, fibroblasts, neutrophils, T-cells, mast cells, eosinophils, epithelial and/or endothelial cells) to a particular site in the body, such as inflammation, infection, or site of hyperproliferation. The mobilized cells can then fight off and/or heal the particular trauma or abnormality.

Polynucleotides or polypeptides, as well as agonists or antagonists of the present invention may increase chemotaxic activity of particular cells. These chemotactic molecules can then be used to treat inflammation, infection, hyperproliferative disorders, or any immune system disorder by increasing the number of cells targeted to a particular location in the body. For example, chemotaxic molecules can be used to treat wounds and other trauma to tissues by attracting immune cells to the injured location. Chemotactic molecules of the present invention can also attract fibroblasts, which can be used to treat wounds.

It is also contemplated that polynucleotides or polypeptides, as well as agonists or antagonists of the present invention may inhibit chemotactic activity. These molecules could also be used to treat disorders. Thus, polynucleotides or polypeptides, as well as agonists or antagonists of the present invention could be used as an inhibitor of chemotaxis.

Binding Activity

A polypeptide of the present invention may be used to screen for molecules that bind to the polypeptide or for molecules to which the polypeptide binds. The binding of the polypeptide and the molecule may activate (agonist), increase, inhibit (antagonist), or decrease activity of the polypeptide or the molecule bound. Examples of such molecules include antibodies, oligonucleotides, proteins (e.g., receptors), or small molecules.

Preferably, the molecule is closely related to the natural ligand of the polypeptide, e.g., a fragment of the ligand, or a natural substrate, a ligand, a structural or functional mimetic. (See, Coligan et al., Current Protocols in Immunology 1(2): Chapter 5 (1991)). Similarly, the molecule can be closely related to the natural receptor to which the polypeptide binds, or at least, a fragment of the receptor capable of being bound by the polypeptide (e.g., active site). In either case, the molecule can be rationally designed using known techniques.

Preferably, the screening for these molecules involves producing appropriate cells which express the polypeptide. Preferred cells include cells from mammals, yeast, Drosophila, or E. coli. Cells expressing the polypeptide (or cell membrane containing the expressed polypeptide) are then preferably contacted with a test compound potentially containing the molecule to observe binding, stimulation, or inhibition of activity of either the polypeptide or the molecule.

The assay may simply test binding of a candidate compound to the polypeptide, wherein binding is detected by a label, or in an assay involving competition with a labeled competitor. Further, the assay may test whether the candidate compound results in a signal generated by binding to the polypeptide.

Alternatively, the assay can be carried out using cell-free preparations, polypeptide/molecule affixed to a solid support, chemical libraries, or natural product mixtures. The assay may also simply comprise the steps of mixing a candidate compound with a solution containing a polypeptide, measuring polypeptide/molecule activity or binding, and comparing the polypeptide/molecule activity or binding to a standard.

Preferably, an ELISA assay can measure polypeptide level or activity in a sample (e.g., biological sample) using a monoclonal or polyclonal antibody. The antibody can measure polypeptide level or activity by either binding, directly or indirectly, to the polypeptide or by competing with the polypeptide for a substrate.

Additionally, the receptor to which the polypeptide of the present invention binds can be identified by numerous methods known to those of skill in the art, for example, ligand panning and FACS sorting (Coligan, et al., Current Protocols in Immun., 1(2), Chapter 5, (1991)). For example, expression cloning is employed wherein polyadenylated RNA is prepared from a cell responsive to the polypeptides, for example, NIH3T3 cells which are known to contain multiple receptors for the FGF family proteins, and SC-3 cells, and a cDNA library created from this RNA is divided into pools and used to transfect COS cells or other cells that are not responsive to the polypeptides. Transfected cells which are grown on glass slides are exposed to the polypeptide of the present invention, after they have been labeled. The polypeptides can be labeled by a variety of means including iodination or inclusion of a recognition site for a site-specific protein kinase.

Following fixation and incubation, the slides are subjected to auto-radiographic analysis. Positive pools are identified and sub-pools are prepared and re-transfected using an iterative sub-pooling and re-screening process, eventually yielding a single clones that encodes the putative receptor.

As an alternative approach for receptor identification, the labeled polypeptides can be photoaffinity linked with cell membrane or extract preparations that express the receptor molecule. Cross-linked material is resolved by PAGE analysis and exposed to X-ray film. The labeled complex containing the receptors of the polypeptides can be excised, resolved into peptide fragments, and subjected to protein microsequencing. The amino acid sequence obtained from microsequencing would be used to design a set of degenerate oligonucleotide probes to screen a cDNA library to identify the genes encoding the putative receptors.

Moreover, the techniques of gene-shuffling, motif-shuffling, exon-shuffling, and/or codon-shuffling (collectively referred to as "DNA shuffling") may be employed to modulate the activities of the polypeptide of the present invention thereby effectively generating agonists and antagonists of the polypeptide of the present invention. See generally, U.S. Pat. Nos. 5,605,793, 5,811,238, 5,830,721, 5,834,252, and 5,837, 458, and Patten, P. A., et al., Curr. Opinion Biotechnol. 8:724-33 (1997); Harayama, S. Trends Biotechnol. 16(2):76-82 (1998); Hansson, L. O., et al., J. Mol. Biol. 287:265-76 (1999); and Lorenzo, M. M. and Blasco, R. Biotechniques 24(2):308-13 (1998); each of these patents and publications are hereby incorporated by reference). In one embodiment, alteration of polynucleotides and corresponding polypeptides may be achieved by DNA shuffling. DNA shuffling involves the assembly of two or more DNA segments into a desired molecule by homologous, or site-specific, recombination. In another embodiment, polynucleotides and corresponding polypeptides may be altered by being subjected to random mutagenesis by error-prone PCR, random nucleotide insertion or other methods prior to recombination. In another embodiment, one or more components, motifs, sections, parts, domains, fragments, etc., of the polypeptide of the present invention may be recombined with one or more components, motifs, sections, parts, domains, fragments, etc. of one or more heterologous molecules. In preferred embodiments, the heterologous molecules are family members. In further preferred embodiments, the heterologous molecule is a growth factor such as, for example, platelet-derived growth factor (PDGF), insulin-like growth factor (IGF-I), transforming growth factor (TGF)-alpha, epidermal growth factor (EGF), fibroblast growth factor (FGF), TGF-beta, bone morphogenetic protein (BMP)-2, BMP-4, BMP-5, BMP-6, BMP-7, activins A and B, decapentaplegic(dpp), 60A, OP-2, dorsalin, growth differentiation factors (GDFs), nodal, MIS, inhibin-alpha, TGF-beta1, TGF-beta2, TGF-beta3, TGF-beta5, and glial-derived neurotrophic factor (GDNF).

Other preferred fragments are biologically active fragments of the polypeptide of the present invention. Biologically active fragments are those exhibiting activity similar, but not necessarily identical, to an activity of the polypeptide of the present invention. The biological activity of the fragments may include an improved desired activity, or a decreased undesirable activity.

Additionally, this invention provides a method of screening compounds to identify those which modulate the action of the polypeptide of the present invention. An example of such an assay comprises combining a mammalian fibroblast cell, a the polypeptide of the present invention, the compound to be screened and $^3$[H] thymidine under cell culture conditions where the fibroblast cell would normally proliferate. A control assay may be performed in the absence of the compound to be screened and compared to the amount of fibroblast proliferation in the presence of the compound to determine if the compound stimulates proliferation by determining the uptake of $^3$[H] thymidine in each case. The amount of fibroblast cell proliferation is measured by liquid scintillation chromatography which measures the incorporation of $^3$[H] thymidine. Both agonist and antagonist compounds may be identified by this procedure.

In another method, a mammalian cell or membrane preparation expressing a receptor for a polypeptide of the present invention is incubated with a labeled polypeptide of the present invention in the presence of the compound. The ability of the compound to enhance or block this interaction could then be measured. Alternatively, the response of a known second messenger system following interaction of a compound to be screened and the receptor is measured and the ability of the compound to bind to the receptor and elicit a second messenger response is measured to determine if the compound is a potential agonist or antagonist. Such second messenger systems include but are not limited to, cAMP guanylate cyclase, ion channels or phosphoinositide hydrolysis.

All of these above assays can be used as diagnostic or prognostic markers. The molecules discovered using these assays can be used to treat disease or to bring about a particular result in a patient (e.g., blood vessel growth) by activating or inhibiting the polypeptide/molecule. Moreover, the assays can discover agents which may inhibit or enhance the production of the polypeptides of the invention from suitably manipulated cells or tissues.

Therefore, the invention includes a method of identifying compounds which bind to a polypeptide of the invention comprising the steps of: (a) incubating a candidate binding compound with a polypeptide of the present invention; and (b) determining if binding has occurred. Moreover, the invention includes a method of identifying agonists/antagonists comprising the steps of: (a) incubating a candidate compound with a polypeptide of the present invention, (b) assaying a biological activity, and (b) determining if a biological activity of the polypeptide has been altered.

Targeted Delivery

In another embodiment, the invention provides a method of delivering compositions to targeted cells expressing a receptor for a polypeptide of the invention, or cells expressing a cell bound form of a polypeptide of the invention.

As discussed herein, polypeptides or antibodies of the invention may be associated with heterologous polypeptides, heterologous nucleic acids, toxins, or prodrugs via hydrophobic, hydrophilic, ionic and/or covalent interactions. In one embodiment, the invention provides a method for the specific delivery of compositions of the invention to cells by administering polypeptides of the invention (including antibodies) that are associated with heterologous polypeptides or nucleic acids. In one example, the invention provides a method for delivering a therapeutic protein into the targeted cell. In another example, the invention provides a method for delivering a single stranded nucleic acid (e.g., antisense or ribozymes) or double stranded nucleic acid (e.g., DNA that can integrate into the cell's genome or replicate episomally and that can be transcribed) into the targeted cell.

In another embodiment, the invention provides a method for the specific destruction of cells (e.g., the destruction of tumor cells) by administering polypeptides of the invention (e.g., polypeptides of the invention or antibodies of the invention) in association with toxins or cytotoxic prodrugs.

By "toxin" is meant compounds that bind and activate endogenous cytotoxic effector systems, radioisotopes, holotoxins, modified toxins, catalytic subunits of toxins, or any molecules or enzymes not normally present in or on the surface of a cell that under defined conditions cause the cell's death. Toxins that may be used according to the methods of the invention include, but are not limited to, radioisotopes known in the art, compounds such as, for example, antibodies (or complement fixing containing portions thereof) that bind an inherent or induced endogenous cytotoxic effector system, thymidine kinase, endonuclease, RNAse, alpha toxin, ricin, abrin, *Pseudomonas* exotoxin A, diphtheria toxin, saporin, momordin, gelonin, pokeweed antiviral protein, alpha-sarcin and cholera toxin. By "cytotoxic prodrug" is meant a nontoxic compound that is converted by an enzyme, normally present in the cell, into a cytotoxic compound. Cytotoxic prodrugs that may be used according to the methods of the invention include, but are not limited to, glutamyl derivatives of benzoic acid mustard alkylating agent, phosphate derivatives of etoposide or mitomycin C, cytosine arabinoside, daunorubisin, and phenoxyacetamide derivatives of doxorubicin.

Drug Screening

Further contemplated is the use of the polypeptides of the present invention, or the polynucleotides encoding these polypeptides, to screen for molecules which modify the activities of the polypeptides of the present invention. Such a method would include contacting the polypeptide of the present invention with a selected compound(s) suspected of having antagonist or agonist activity, and assaying the activity of these polypeptides following binding.

This invention is particularly useful for screening therapeutic compounds by using the polypeptides of the present invention, or binding fragments thereof, in any of a variety of drug screening techniques. The polypeptide or fragment employed in such a test may be affixed to a solid support, expressed on a cell surface, free in solution, or located intracellularly. One method of drug screening utilizes eukaryotic or prokaryotic host cells which are stably transformed with recombinant nucleic acids expressing the polypeptide or fragment. Drugs are screened against such transformed cells in competitive binding assays. One may measure, for example, the formulation of complexes between the agent being tested and a polypeptide of the present invention.

Thus, the present invention provides methods of screening for drugs or any other agents which affect activities mediated by the polypeptides of the present invention. These methods comprise contacting such an agent with a polypeptide of the present invention or a fragment thereof and assaying for the presence of a complex between the agent and the polypeptide or a fragment thereof, by methods well known in the art. In such a competitive binding assay, the agents to screen are typically labeled. Following incubation, free agent is separated from that present in bound form, and the amount of free or uncomplexed label is a measure of the ability of a particular agent to bind to the polypeptides of the present invention.

Another technique for drug screening provides high throughput screening for compounds having suitable binding affinity to the polypeptides of the present invention, and is described in great detail in European Patent Application 84/03564, published on Sep. 13, 1984, which is incorporated herein by reference herein. Briefly stated, large numbers of different small peptide test compounds are synthesized on a solid substrate, such as plastic pins or some other surface. The peptide test compounds are reacted with polypeptides of the present invention and washed. Bound polypeptides are then detected by methods well known in the art. Purified polypeptides are coated directly onto plates for use in the aforementioned drug screening techniques. In addition, non-neutralizing antibodies may be used to capture the peptide and immobilize it on the solid support.

This invention also contemplates the use of competitive drug screening assays in which neutralizing antibodies capable of binding polypeptides of the present invention specifically compete with a test compound for binding to the polypeptides or fragments thereof. In this manner, the antibodies are used to detect the presence of any peptide which shares one or more antigenic epitopes with a polypeptide of the invention.

Polypeptides of the Invention Binding Peptides and Other Molecules

The invention also encompasses screening methods for identifying polypeptides and nonpolypeptides that bind polypeptides of the invention, and the polypeptide of the invention binding molecules identified thereby. These binding molecules are useful, for example, as agonists and antagonists of the polypeptides of the invention. Such agonists and antagonists can be used, in accordance with the invention, in the therapeutic embodiments described in detail, below.

This method comprises the steps of:contacting a polypeptide of the invention with a plurality of molecules; and identifying a molecule that binds the polypeptide of the invention.

The step of contacting the polypeptide of the invention with the plurality of molecules may be effected in a number of ways. For example, one may contemplate immobilizing the polypeptide of the invention on a solid support and bringing a solution of the plurality of molecules in contact with the immobilized polypeptide of the invention. Such a procedure would be akin to an affinity chromatographic process, with the affinity matrix being comprised of the immobilized polypeptide of the invention. The molecules having a selective affinity for the polypeptide of the invention can then be purified by affinity selection. The nature of the solid support, process for attachment of the polypeptide of the invention to the solid support, solvent, and conditions of the affinity isolation or selection are largely conventional and well known to those of ordinary skill in the art.

Alternatively, one may also separate a plurality of polypeptides into substantially separate fractions comprising a subset of or individual polypeptides. For instance, one can separate the plurality of polypeptides by gel electrophoresis, column chromatography, or like method known to those of ordinary skill for the separation of polypeptides. The individual polypeptides can also be produced by a transformed host cell in such a way as to be expressed on or about its outer surface (e.g., a recombinant phage). Individual isolates can then be "probed" by the polypeptide of the invention, optionally in the presence of an inducer should one be required for expression, to determine if any selective affinity interaction takes place between the polypeptide of the invention and the individual clone. Prior to contacting the polypeptide of the invention with each fraction comprising individual polypeptides, the polypeptides could first be transferred to a solid support for additional convenience. Such a solid support may simply be a piece of filter membrane, such as one made of nitrocellulose or nylon. In this manner, positive clones could be identified from a collection of transformed host cells of an expression library, which harbor a DNA construct encoding a polypeptide having a selective affinity for a polypeptide of the invention. Furthermore, the amino acid sequence of the polypeptide having a selective affinity for the polypeptide of the invention can be determined directly by conventional means or the coding sequence of the DNA encoding the polypeptide can frequently be determined more conveniently. The primary sequence can then be deduced from the corresponding DNA sequence. If the amino acid sequence is to be determined from the polypeptide itself, one may use microsequencing techniques. The sequencing technique may include mass spectroscopy.

In certain situations, it may be desirable to wash away any unbound polypeptide of the invention, or alterntatively, unbound polypeptides, from a mixture of the polypeptide of the invention and the plurality of polypeptides prior to attempting to determine or to detect the presence of a selective affinity interaction. Such a wash step may be particularly desirable when the polypeptide of the invention or the plurality of polypeptides is bound to a solid support.

The plurality of molecules provided according to this method may be provided by way of diversity libraries, such as random or combinatorial peptide or nonpeptide libraries which can be screened for molecules that specifically bind to a polypeptide of the invention. Many libraries are known in the art that can be used, e.g., chemically synthesized libraries, recombinant (e.g., phage display libraries), and in vitro translation-based libraries. Examples of chemically synthesized libraries are described in Fodor et al., 1991, Science 251:767-773; Houghten et al., 1991, Nature 354:84-86; Lam et al., 1991, Nature 354:82-84; Medynski, 1994, Bio/Technology 12:709-710;Gallop et al., 1994, J. Medicinal Chemistry 37(9):1233-1251; Ohlmeyer et al., 1993, Proc. Natl. Acad. Sci. USA 90:10922-10926; Erb et al., 1994, Proc. Natl. Acad. Sci. USA 91:11422-11426; Houghten et al., 1992, Biotechniques 13:412; Jayawickreme et al., 1994, Proc. Natl. Acad. Sci. USA 91:1614-1618; Salmon et al., 1993, Proc. Natl. Acad. Sci. USA 90:11708-11712; PCT Publication No. WO 93/20242; and Brenner and Lerner, 1992, Proc. Natl. Acad. Sci. USA 89:5381-5383.

Examples of phage display libraries are described in Scott and Smith, 1990, Science 249:386-390; Devlin et al., 1990, Science, 249:404-406; Christian, R. B., et al., 1992, J. Mol. Biol. 227:711-718); Lenstra, 1992, J. Immunol. Meth. 152: 149-157; Kay et al., 1993, Gene 128:59-65; and PCT Publication No. WO 94/18318 dated Aug. 18, 1994.

In vitro translation-based libraries include but are not limited to those described in PCT Publication No. WO 91/05058 dated Apr. 18, 1991; and Mattheakis et al., 1994, Proc. Natl. Acad. Sci. USA 91:9022-9026.

By way of examples of nonpeptide libraries, a benzodiazepine library (see e.g., Bunin et al., 1994, Proc. Natl. Acad. Sci. USA 91:4708-4712) can be adapted for use. Peptoid libraries (Simon et al., 1992, Proc. Natl. Acad. Sci. USA 89:9367-9371) can also be used. Another example of a library that can be used, in which the amide functionalities in peptides have been permethylated to generate a chemically transformed combinatorial library, is described by Ostresh et al. (1994, Proc. Natl. Acad. Sci. USA 91:11138-11142).

The variety of non-peptide libraries that are useful in the present invention is great. For example, Ecker and Crooke, 1995, Bio/Technology 13:351-360 list benzodiazepines, hydantoins, piperazinediones, biphenyls, sugar analogs, beta-mercaptoketones, arylacetic acids, acylpiperidines, benzopyrans, cubanes, xanthines, aminimides, and oxazolones as among the chemical species that form the basis of various libraries.

Non-peptide libraries can be classified broadly into two types: decorated monomers and oligomers. Decorated monomer libraries employ a relatively simple scaffold structure upon which a variety functional groups is added. Often the scaffold will be a molecule with a known useful pharmacological activity. For example, the scaffold might be the benzodiazepine structure.

Non-peptide oligomer libraries utilize a large number of monomers that are assembled together in ways that create new shapes that depend on the order of the monomers. Among the monomer units that have been used are carbamates, pyrrolinones, and morpholinos. Peptoids, peptide-like oligomers in which the side chain is attached to the alpha amino group rather than the alpha carbon, form the basis of another version of non-peptide oligomer libraries. The first non-peptide oligomer libraries utilized a single type of monomer and thus contained a repeating backbone. Recent libraries have utilized more than one monomer, giving the libraries added flexibility.

Screening the libraries can be accomplished by any of a variety of commonly known methods. See, e.g., the following references, which disclose screening of peptide libraries: Parmley and Smith, 1989, Adv. Exp. Med. Biol. 251:215-218; Scott and Smith, 1990, Science 249:386-390; Fowlkes et al., 1992; BioTechniques 13:422-427; Oldenburg et al., 1992, Proc. Natl. Acad. Sci. USA 89:5393-5397; Yu et al., 1994, Cell 76:933-945; Staudt et al., 1988, Science 241:577-580; Bock et al., 1992, Nature 355:564-566; Tuerk et al., 1992, Proc. Natl. Acad. Sci. USA 89:6988-6992; Ellington et al., 1992, Nature 355:850-852; U.S. Pat. No. 5,096,815, U.S. Pat. No. 5,223,409, and U.S. Pat. No. 5,198,346, all to Ladner et al.; Rebar and Pabo, 1993, Science 263:671-673; and CT Publication No. WO 94/18318.

In a specific embodiment, screening to identify a molecule that binds a polypeptide of the invention can be carried out by contacting the library members with a polypeptide of the invention immobilized on a solid phase and harvesting those library members that bind to the polypeptide of the invention. Examples of such screening methods, termed "panning" techniques are described by way of example in Parmley and Smith, 1988, Gene 73:305-318; Fowlkes et al., 1992, Bio-Techniques 13:422-427; PCT Publication No. WO 94/18318; and in references cited herein.

In another embodiment, the two-hybrid system for selecting interacting proteins in yeast (Fields and Song, 1989, Nature 340:245-246; Chien et al., 1991, Proc. Natl. Acad. Sci. USA 88:9578-9582) can be used to identify molecules that specifically bind to a polypeptide of the invention.

Where the polypeptide of the invention binding molecule is a polypeptide, the polypeptide can be conveniently selected from any peptide library, including random peptide libraries, combinatorial peptide libraries, or biased peptide libraries. The term "biased" is used herein to mean that the method of generating the library is manipulated so as to restrict one or more parameters that govern the diversity of the resulting collection of molecules, in this case peptides.

Thus, a truly random peptide library would generate a collection of peptides in which the probability of finding a particular amino acid at a given position of the peptide is the same for all 20 amino acids. A bias can be introduced into the library, however, by specifying, for example, that a lysine occur every fifth amino acid or that positions 4, 8, and 9 of a decapeptide library be fixed to include only arginine. Clearly, many types of biases can be contemplated, and the present invention is not restricted to any particular bias. Furthermore, the present invention contemplates specific types of peptide libraries, such as phage displayed peptide libraries and those that utilize a DNA construct comprising a lambda phage vector with a DNA insert.

As mentioned above, in the case of a polypeptide of the invention binding molecule that is a polypeptide, the polypeptide may have about 6 to less than about 60 amino acid residues, preferably about 6 to about 10 amino acid residues, and most preferably, about 6 to about 22 amino acids. In another embodiment, a polypeptide of the invention binding polypeptide has in the range of 15-100 amino acids, or 20-50 amino acids.

The selected polypeptide of the invention binding polypeptide can be obtained by chemical synthesis or recombinant expression.

Antisense And Ribozyme (Antagonists)

In specific embodiments, antagonists according to the present invention are nucleic acids corresponding to the sequences contained in SEQ ID NO:X, or the complementary strand thereof, and/or to nucleotide sequences contained a deposited clone. In one embodiment, antisense sequence is generated internally by the organism, in another embodiment, the antisense sequence is separately administered (see, for example, O'Connor, Neurochem., 56:560 (1991). Oligodeoxynucleotides as Anitsense Inhibitors of Gene Expression, CRC Press, Boca Raton, Fla. (1988). Antisense technology can be used to control gene expression through antisense DNA or RNA, or through triple-helix formation. Antisense techniques are discussed for example, in Okano, Neurochem., 56:560 (1991); Oligodeoxynucleotides as Antisense Inhibitors of Gene Expression, CRC Press, Boca Raton, Fla. (1988). Triple helix formation is discussed in, for instance, Lee et al., Nucleic Acids Research, 6:3073 (1979); Cooney et al., Science, 241:456 (1988); and Dervan et al., Science, 251:1300 (1991). The methods are based on binding of a polynucleotide to a complementary DNA or RNA.

For example, the use of c-myc and c-myb antisense RNA constructs to inhibit the growth of the non-lymphocytic leukemia cell line HL-60 and other cell lines was previously described. (Wickstrom et al. (1988); Anfossi et al. (1989)). These experiments were performed in vitro by incubating cells with the oligoribonucleotide. A similar procedure for in vivo use is described in WO 91/15580. Briefly, a pair of oligonucleotides for a given antisense RNA is produced as follows: A sequence complimentary to the first 15 bases of the open reading frame is flanked by an EcoRI site on the 5 end and a HindIII site on the 3 end. Next, the pair of oligonucleotides is heated at 90° C. for one minute and then annealed in 2× ligation buffer (20 mM TRIS HCl pH 7.5, 10 mM MgCl$_2$, 10 MM dithiothreitol (DTT) and 0.2 mM ATP) and then ligated to the EcoRI/Hind III site of the retroviral vector PMV7 (WO 91/15580).

For example, the 5' coding portion of a polynucleotide that encodes the mature polypeptide of the present invention may be used to design an antisense RNA oligonucleotide of from about 10 to 40 base pairs in length. A DNA oligonucleotide is designed to be complementary to a region of the gene involved in transcription thereby preventing transcription and the production of the receptor. The antisense RNA oligonucleotide hybridizes to the mRNA in vivo and blocks translation of the mRNA molecule into receptor polypeptide.

In one embodiment, the antisense nucleic acid of the invention is produced intracellularly by transcription from an exogenous sequence. For example, a vector or a portion thereof, is transcribed, producing an antisense nucleic acid (RNA) of the invention. Such a vector would contain a sequence encoding the antisense nucleic acid of the invention. Such a vector can remain episomal or become chromosomally integrated, as long as it can be transcribed to produce the desired antisense RNA. Such vectors can be constructed by recombinant DNA technology methods standard in the art. Vectors can be plasmid, viral, or others known in the art, used for replication and expression in vertebrate cells. Expression of the sequence encoding a polypeptide of the invention, or fragments thereof, can be by any promoter known in the art to act in vertebrate, preferably human cells. Such promoters can be inducible or constitutive. Such promoters include, but are not limited to, the SV40 early promoter region (Bernoist and Chambon, Nature, 29:304-310 (1981), the promoter contained in the 3' long terminal repeat of Rous sarcoma virus (Yamamoto et al., Cell, 22:787-797 (1980), the herpes thymidine promoter (Wagner et al., Proc. Natl. Acad. Sci. U.S.A., 78:1441-1445 (1981), the regulatory sequences of the metallothionein gene (Brinster et al., Nature, 296:39-42 (1982)), etc.

The antisense nucleic acids of the invention comprise a sequence complementary to at least a portion of an RNA transcript of a gene of interest. However, absolute complementarity, although preferred, is not required. A sequence "complementary to at least a portion of an RNA," referred to herein, means a sequence having sufficient complementarity to be able to hybridize with the RNA, forming a stable duplex; in the case of double stranded antisense nucleic acids of the invention, a single strand of the duplex DNA may thus be tested, or triplex formation may be assayed. The ability to hybridize will depend on both the degree of complementarity and the length of the antisense nucleic acid Generally, the larger the hybridizing nucleic acid, the more base mismatches with a RNA sequence of the invention it may contain and still form a stable duplex (or triplex as the case may be). One skilled in the art can ascertain a tolerable degree of mismatch by use of standard procedures to determine the melting point of the hybridized complex.

Oligonucleotides that are complementary to the 5' end of the message, e.g., the 5' untranslated sequence up to and including the AUG initiation codon, should work most efficiently at inhibiting translation. However, sequences complementary to the 3' untranslated sequences of mRNAs have been shown to be effective at inhibiting translation of mRNAs as well. See generally, Wagner, R., Nature, 372:333-335 (1994). Thus, oligonucleotides complementary to either the 5'- or 3'-non-translated, non-coding regions of a polynucleotide sequence of the invention could be used in an antisense approach to inhibit translation of endogenous mRNA. Oligonucleotides complementary to the 5' untranslated region of the mRNA should include the complement of the AUG start codon. Antisense oligonucleotides complementary to mRNA coding regions are less efficient inhibitors of translation but could be used in accordance with the invention. Whether designed to hybridize to the 5'-, 3'- or coding region of mRNA, antisense nucleic acids should be at least six nucleotides in length, and are preferably oligonucleotides ranging from 6 to about 50 nucleotides in length. In specific aspects the oligonucleotide is at least 10 nucleotides, at least 17 nucleotides, at least 25 nucleotides or at least 50 nucleotides.

The polynucleotides of the invention can be DNA or RNA or chimeric mixtures or derivatives or modified versions thereof, single-stranded or double-stranded. The oligonucleotide can be modified at the base moiety, sugar moiety, or phosphate backbone, for example, to improve stability of the molecule, hybridization, etc. The oligonucleotide may include other appended groups such as peptides (e.g., for targeting host cell receptors in vivo), or agents facilitating transport across the cell membrane (see, e.g., Letsinger et al., Proc. Natl. Acad. Sci. U.S.A. 86:6553-6556 (1989); Lemaitre et al., Proc. Natl. Acad. Sci., 84:648-652 (1987); PCT Publication NO: WO88/09810, published Dec. 15, 1988) or the blood-brain barrier (see, e.g., PCT Publication NO: WO89/10134, published Apr. 25, 1988), hybridization-triggered cleavage agents. (See, e.g., Krol et al., BioTechniques, 6:958-976 (1988)) or intercalating agents. (See, e.g., Zon, Pharm. Res., 5:539-549 (1988)). To this end, the oligonucleotide may be conjugated to another molecule, e.g., a peptide, hybridization triggered cross-linking agent, transport agent, hybridization-triggered cleavage agent, etc.

The antisense oligonucleotide may comprise at least one modified base moiety which is selected from the group including, but not limited to, 5-fluorouracil, 5-bromouracil, 5-chlorouracil, 5-iodouracil, hypoxanthine, xantine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N-6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N2-carboxypropyl) uracil, (acp3)$_w$, and 2,6-diaminopurine.

The antisense oligonucleotide may also comprise at least one modified sugar moiety selected from the group including, but not limited to, arabinose, 2-fluoroarabinose, xylulose, and hexose.

In yet another embodiment, the antisense oligonucleotide comprises at least one modified phosphate backbone selected from the group including, but not limited to, a phosphorothioate, a phosphorodithioate, a phosphoramidothioate, a phosphoramidate, a phosphordiamidate, a methylphosphonate, an alkyl phosphotriester, and a formacetal or analog thereof.

In yet another embodiment, the antisense oligonucleotide is an a-anomeric oligonucleotide. An a-anomeric oligonucleotide forms specific double-stranded hybrids with complementary RNA in which, contrary to the usual b-units, the strands run parallel to each other (Gautier et al., Nucl. Acids Res., 15:6625-6641 (1987)). The oligonucleotide is a 2-O-methylribonucleotide (Inoue et al., Nucl. Acids Res., 15:6131-6148 (1987)), or a chimeric RNA-DNA analogue (Inoue et al., FEBS Lett. 215:327-330 (1987)).

Polynucleotides of the invention may be synthesized by standard methods known in the art, e.g. by use of an automated DNA synthesizer (such as are commercially available from Biosearch, Applied Biosystems, etc.). As examples, phosphorothioate oligonucleotides may be synthesized by the method of Stein et al. (Nucl. Acids Res., 16:3209 (1988)), methylphosphonate oligonucleotides can be prepared by use of controlled pore glass polymer supports (Sarin et al., Proc. Natl. Acad. Sci. U.S.A., 85:7448-7451 (1988)), etc.

While antisense nucleotides complementary to the coding region sequence of the invention could be used, those complementary to the transcribed untranslated region are most preferred.

Potential antagonists according to the invention also include catalytic RNA, or a ribozyme (See, e.g., PCT International Publication WO 90/11364, published Oct. 4, 1990; Sarver et al, Science, 247:1222-1225 (1990). While ribozymes that cleave mRNA at site specific recognition sequences can be used to destroy mRNAs corresponding to the polynucleotides of the invention, the use of hammerhead ribozymes is preferred. Hammerhead ribozymes cleave mRNAs at locations dictated by flanking regions that form complementary base pairs with the target mRNA. The sole requirement is that the target mRNA have the following sequence of two bases: 5'-UG-3'. The construction and production of hammerhead ribozymes is well known in the art and is described more fully in Haseloff and Gerlach, Nature, 334:585-591 (1988). There are numerous potential hammerhead ribozyme cleavage sites within each nucleotide sequence disclosed in the sequence listing. Preferably, the ribozyme is engineered so that the cleavage recognition site is located near the 5' end of the mRNA corresponding to the polynucleotides of the invention; i.e., to increase efficiency and minimize the intracellular accumulation of non-functional mRNA transcripts.

As in the antisense approach, the ribozymes of the invention can be composed of modified oligonucleotides (e.g. for improved stability, targeting, etc.) and should be delivered to cells which express the polynucleotides of the invention in vivo. DNA constructs encoding the ribozyme may be introduced into the cell in the same manner as described above for the introduction of antisense encoding DNA. A preferred method of delivery involves using a DNA construct "encoding" the ribozyme under the control of a strong constitutive promoter, such as, for example, pol III or pol II promoter, so that transfected cells will produce sufficient quantities of the ribozyme to destroy endogenous messages and inhibit translation. Since ribozymes unlike antisense molecules, are catalytic, a lower intracellular concentration is required for efficiency.

Antagonist/agonist compounds may be employed to inhibit the cell growth and proliferation effects of the polypeptides of the present invention on neoplastic cells and tissues, i.e. stimulation of angiogenesis of tumors, and, therefore, retard or prevent abnormal cellular growth and proliferation, for example, in tumor formation or growth.

The antagonist/agonist may also be employed to prevent hyper-vascular diseases, and prevent the proliferation of epithelial lens cells after extracapsular cataract surgery. Prevention of the mitogenic activity of the polypeptides of the present invention may also be desirous in cases such as restenosis after balloon angioplasty.

The antagonist/agonist may also be employed to prevent the growth of scar tissue during wound healing.

The antagonist/agonist may also be employed to treat, prevent, and/or diagnose the diseases described herein.

Thus, the invention provides a method of treating or preventing diseases, disorders, and/or conditions, including but not limited to the diseases, disorders, and/or conditions listed throughout this application, associated with overexpression of a polynucleotide of the present invention by administering to a patient (a) an antisense molecule directed to the polynucleotide of the present invention, and/or (b) a ribozyme directed to the polynucleotide of the present invention.

Other Activities

The polypeptide of the present invention, as a result of the ability to stimulate vascular endothelial cell growth, may be employed in treatment for stimulating re-vascularization of ischemic tissues due to various disease conditions such as thrombosis, arteriosclerosis, and other cardiovascular conditions. These polypeptide may also be employed to stimulate angiogenesis and limb regeneration, as discussed above.

The polypeptide may also be employed for treating wounds due to injuries, burns, post-operative tissue repair, and ulcers since they are mitogenic to various cells of different origins, such as fibroblast cells and skeletal muscle cells, and therefore, facilitate the repair or replacement of damaged or diseased tissue.

The polypeptide of the present invention may also be employed stimulate neuronal growth and to treat, prevent, and/or diagnose neuronal damage which occurs in certain neuronal disorders or neuro-degenerative conditions such as Alzheimer's disease, Parkinson's disease, and AIDS-related complex. The polypeptide of the invention may have the ability to stimulate chondrocyte growth, therefore, they may be employed to enhance bone and periodontal regeneration and aid in tissue transplants or bone grafts.

The polypeptide of the present invention may be also be employed to prevent skin aging due to sunburn by stimulating keratinocyte growth.

The polypeptide of the invention may also be employed for preventing hair loss, since FGF family members activate hair-forming cells and promotes melanocyte growth. Along the same lines, the polypeptides of the present invention may be employed to stimulate growth and differentiation of hematopoietic cells and bone marrow cells when used in combination with other cytokines.

The polypeptide of the invention may also be employed to maintain organs before transplantation or for supporting cell culture of primary tissues.

The polypeptide of the present invention may also be employed for inducing tissue of mesodermal origin to differentiate in early embryos.

The polypeptide or polynucleotides and/or agonist or antagonists of the present invention may also increase or decrease the differentiation or proliferation of embryonic stem cells, besides, as discussed above, hematopoietic lineage.

The polypeptide or polynucleotides and/or agonist or antagonists of the present invention may also be used to modulate mammalian characteristics, such as body height, weight, hair color, eye color, skin, percentage of adipose tissue, pigmentation, size, and shape (e.g., cosmetic surgery). Similarly, polypeptides or polynucleotides and/or agonist or antagonists of the present invention may be used to modulate mammalian metabolism affecting catabolism, anabolism, processing, utilization, and storage of energy.

A polypeptide, polynucleotide, agonist, or antagonist of the present invention may be used to treat weight disorders, including but not limited to, obesity, cachexia, wasting disease, anorexia, and bulimia.

Polypeptide or polynucleotides and/or agonist or antagonists of the present invention may be used to change a mammal's mental state or physical state by influencing biorhythms, caricadic rhythms, depression (including depressive diseases, disorders, and/or conditions), tendency for violence, tolerance for pain, reproductive capabilities (preferably by Activin or Inhibin-like activity), hormonal or endocrine levels, appetite, libido, memory, stress, or other cognitive qualities.

Polypeptide or polynucleotides and/or agonist or antagonists of the present invention may also be used as a food additive or preservative, such as to increase or decrease storage capabilities, fat content, lipid, protein, carbohydrate, vitamins, minerals, cofactors or other nutritional components.

Other Preferred Embodiments

Other preferred embodiments of the claimed invention include an isolated nucleic acid molecule comprising a nucleotide sequence which is at least 95% identical to a sequence of at least about 50 contiguous nucleotides in the nucleotide sequence of SEQ ID NO:X wherein X is any integer as defined in Table 1A. Also preferred is the above nucleic acid molecule wherein said sequence of contiguous nucleotides is included in the nucleotide sequence of SEQ ID NO:X in the range of positions beginning with the nucleotide at about the position of the 5' Nucleotide of the Clone Sequence and ending with the nucleotide at about the position of the 3' Nucleotide of the Clone Sequence as defined for SEQ ID NO:X in Table 1A. Further preferred is the above nucleic acid molecule wherein said sequence of contiguous nucleotides is included in the nucleotide sequence of SEQ ID NO:X in the range of positions beginning with the nucleotide at about the position of the 5' Nucleotide of the Start Codon and ending with the nucleotide at about the position of the 3' Nucleotide of the Clone Sequence as defined for SEQ ID NO:X in Table 1A. Similarly preferred is the above nucleic acid molecule wherein said sequence of contiguous nucleotides is included in the nucleotide sequence of SEQ ID NO:X in the range of positions beginning with the nucleotide at about the position of the 5' Nucleotide of the First Amino Acid of the Signal Peptide and ending with the nucleotide at about the position of the 3' Nucleotide of the Clone Sequence as defined for SEQ ID NO:X in Table 1A.

Also preferred is an isolated nucleic acid molecule comprising a nucleotide sequence which is at least 95% identical to a sequence of at least about 150 contiguous nucleotides in the nucleotide sequence of SEQ ID NO:X.

Further preferred is an isolated nucleic acid molecule comprising a nucleotide sequence which is at least 95% identical to a sequence of at least about 500 contiguous nucleotides in the nucleotide sequence of SEQ ID NO:X.

A further preferred embodiment is a nucleic acid molecule comprising a nucleotide sequence which is at least 95% identical to the nucleotide sequence of SEQ ID NO:X beginning with the nucleotide at about the position of the 5' Nucleotide of the First Amino Acid of the Signal Peptide and ending with the nucleotide at about the position of the 3' Nucleotide of the Clone Sequence as defined for SEQ ID NO:X in Table 1A.

A further preferred embodiment is an isolated nucleic acid molecule comprising a nucleotide sequence which is at least 95% identical to the complete nucleotide sequence of SEQ ID NO:X.

Also preferred is an isolated nucleic acid molecule which hybridizes under stringent hybridization conditions to a nucleic acid molecule, wherein said isolated nucleic acid molecule does not hybridize under stringent hybridization conditions to a nucleic acid molecule having a nucleotide sequence consisting of only A residues or of only T residues.

Also preferred is a composition of matter comprising a DNA molecule which comprises a human cDNA clone identified by a cDNA Clone Identifier in Table 1A, which DNA molecule is contained in the material deposited with the American Type Culture Collection and given the ATCC Deposit Number shown in Table 1A for said cDNA Clone Identifier.

Also preferred is an isolated nucleic acid molecule comprising a nucleotide sequence which is at least 95% identical to a sequence of at least 50 contiguous nucleotides in the nucleotide sequence of the cDNA of a human cDNA clone identified by a cDNA Clone Identifier in Table 1A, which DNA molecule is contained in the deposit given the ATCC Deposit Number shown in Table 1A. Further preferred is the above nucleic acid molecule, wherein said sequence of at least 50 contiguous nucleotides is included in the nucleotide sequence of the complete open reading frame sequence encoded by said human cDNA clone. In addition, an isolated nucleic acid molecule of the invention may comprise a nucleotide sequence which is at least 95% identical to sequence of at least 150 contiguous nucleotides in the nucleotide sequence of the cDNA in said human cDNA clone. A further preferred embodiment is an isolated nucleic acid molecule comprising a nucleotide sequence which is at least 95% identical to sequence of at least 500 contiguous nucleotides in the nucleotide sequence of the cDNA in said human cDNA clone. A further preferred embodiment is an isolated nucleic acid molecule comprising a nucleotide sequence which is at least 95% identical to the complete nucleotide sequence of the cDNA in said human cDNA clone.

A further preferred embodiment is a method for detecting in a biological sample a nucleic acid molecule comprising a nucleotide sequence which is at least 95% identical to a sequence of at least 50 contiguous nucleotides in a sequence selected from the group consisting of: a nucleotide sequence of SEQ ID NO:X wherein X is any integer as defined in Table 1A; and a nucleotide sequence encoded by a human cDNA clone identified by a cDNA Clone Identifier in Table 1A and contained in the deposit with the ATCC Deposit Number shown for said cDNA clone in Table 1A; which method comprises: (a) a step of comparing a nucleotide sequence of at least one nucleic acid molecule in said sample with a sequence selected from said group; and (b) determining whether the sequence of said nucleic acid molecule in said sample is at least 95% identical to said selected sequence. The step of comparing sequences in the above method may further comprise determining the extent of nucleic acid hybridization between nucleic acid molecules in said sample and a nucleic acid molecule comprising said sequence selected from said group. Similarly, the step of comparing sequences in the above method may be performed by comparing the nucleotide sequence determined from a nucleic acid molecule in said sample with said sequence selected from said group. The nucleic acid molecules can comprise DNA molecules or RNA molecules.

A further preferred embodiment is a method for identifying the species, tissue or cell type of a biological sample which method comprises a step of detecting nucleic acid molecules in said sample, if any, comprising a nucleotide sequence that is at least 95% identical to a sequence of at least 50 contiguous nucleotides in a sequence selected from the group consisting of: a nucleotide sequence of SEQ ID NO:X wherein X is any integer as defined in Table 1A; and a nucleotide sequence encoded by a human cDNA clone identified by a cDNA Clone Identifier in Table 1A and contained in the deposit with the ATCC Deposit Number shown for said cDNA clone in Table 1A. This method described above may further comprise a step of detecting nucleic acid molecules comprising a nucleotide sequence in a panel of at least two nucleotide sequences, wherein at least one sequence in said panel is at least 95% identical to a sequence of at least 50 contiguous nucleotides in a sequence selected from said group.

Also preferred is a method for diagnosing in a subject a pathological condition associated with abnormal structure or expression of a gene encoding a secreted protein identified in Table 1A, which method comprises a step of detecting in a biological sample obtained from said subject nucleic acid molecules, if any, comprising a nucleotide sequence that is at least 95% identical to a sequence of at least 50 contiguous nucleotides in a sequence selected from the group consisting of: a nucleotide sequence of SEQ ID NO:X wherein X is any integer as defined in Table 1A; and a nucleotide sequence encoded by a human cDNA clone identified by a cDNA Clone Identifier in Table 1A and contained in the deposit with the ATCC Deposit Number shown for said cDNA clone in Table 1A. This method described above may further comprise a step of detecting nucleic acid molecules comprising a nucleotide sequence in a panel of at least two nucleotide sequences, wherein at least one sequence in said panel is at least 95% identical to a sequence of at least 50 contiguous nucleotides in a sequence selected from said group.

Also preferred is a composition of matter comprising isolated nucleic acid molecules wherein the nucleotide sequences of said nucleic acid molecules comprise a panel of at least two nucleotide sequences, wherein at least one sequence in said panel is at least 95% identical to a sequence of at least 50 contiguous nucleotides in a sequence selected from the group consisting of: a nucleotide sequence of SEQ ID NO:X wherein X is any integer as defined in Table 1A; and a nucleotide sequence encoded by a human cDNA clone identified by a cDNA Clone Identifier in Table 1A and contained in the deposit with the ATCC Deposit Number shown for said cDNA clone in Table 1A. The nucleic acid molecules can comprise DNA molecules or RNA molecules.

Also preferred is an isolated polypeptide comprising an amino acid sequence at least 90% identical to a sequence of at least about 10 contiguous amino acids in the amino acid sequence of SEQ ID NO:Y wherein Y is any integer as defined in Table 1A. Further preferred is the above isolated polypeptide, wherein said sequence of contiguous amino acids is included in the amino acid sequence of SEQ ID NO:Y in the range of positions beginning with the residue at about the position of the First Amino Acid of the Secreted Portion and ending with the residue at about the Last Amino Acid of the Open Reading Frame as set forth for SEQ ID NO:Y in Table 1A.

Also preferred is an isolated polypeptide comprising an amino acid sequence at least 95% identical to a sequence of at least about 30 contiguous amino acids in the amino acid sequence of SEQ ID NO:Y.

Further preferred is an isolated polypeptide comprising an amino acid sequence at least 95% identical to a sequence of at least about 100 contiguous amino acids in the amino acid sequence of SEQ ID NO:Y.

Further preferred is an isolated polypeptide comprising an amino acid sequence at least 95% identical to the complete amino acid sequence of SEQ ID NO:Y.

Also preferred is an isolated polypeptide comprising an amino acid sequence at least 90% identical to a sequence of at least about 10 contiguous amino acids in the complete amino acid sequence of a secreted protein encoded by a human cDNA clone identified by a cDNA Clone Identifier in Table 1A and contained in the deposit with the ATCC Deposit Number shown for said cDNA clone in Table 1A. Further preferred is the above isolated polypeptide wherein said sequence of contiguous amino acids is included in the amino acid sequence of a secreted portion of the secreted protein encoded by a human cDNA clone identified by a cDNA Clone Identifier in Table 1A and contained in the deposit with the ATCC Deposit Number shown for said cDNA clone in Table 1A.

Also preferred is an isolated polypeptide comprising an amino acid sequence at least 95% identical to a sequence of at least about 30 contiguous amino acids in the amino acid sequence of the secreted portion of the protein encoded by a human cDNA clone identified by a cDNA Clone Identifier in Table 1A and contained in the deposit with the ATCC Deposit Number shown for said cDNA clone in Table 1A.

Also preferred is an isolated polypeptide comprising an amino acid sequence at least 95% identical to a sequence of at least about 100 contiguous amino acids in the amino acid sequence of the secreted portion of the protein encoded by a human cDNA clone identified by a cDNA Clone Identifier in Table 1A and contained in the deposit with the ATCC Deposit Number shown for said cDNA clone in Table 1A.

Also preferred is an isolated polypeptide comprising an amino acid sequence at least 95% identical to the amino acid sequence of the secreted portion of the protein encoded by a human cDNA clone identified by a cDNA Clone Identifier in Table 1A and contained in the deposit with the ATCC Deposit Number shown for said cDNA clone in Table 1A.

Further preferred is an isolated antibody which binds specifically to a polypeptide comprising an amino acid sequence that is at least 90% identical to a sequence of at least 10 contiguous amino acids in a sequence selected from the group consisting of: an amino acid sequence of SEQ ID NO:Y wherein Y is any integer as defined in Table 1A; and a complete amino acid sequence of a protein encoded by a human cDNA clone identified by a cDNA Clone Identifier in Table 1A and contained in the deposit with the ATCC Deposit Number shown for said cDNA clone in Table 1A.

Further preferred is a method for detecting in a biological sample a polypeptide comprising an amino acid sequence which is at least 90% identical to a sequence of at least 10 contiguous amino acids in a sequence selected from the group consisting of: an amino acid sequence of SEQ ID NO:Y wherein Y is any integer as defined in Table 1A; and a complete amino acid sequence of a protein encoded by a human cDNA clone identified by a cDNA Clone Identifier in Table 1A and contained in the deposit with the ATCC Deposit Number shown for said cDNA clone in Table 1A; which method comprises: (a) a step of comparing an amino acid sequence of at least one polypeptide molecule in said sample with a sequence selected from said group; and (b) determining whether the sequence of said polypeptide molecule in said sample is at least 90% identical to said sequence of at least 10 contiguous amino acids. The step in the above method of comparing an amino acid sequence of at least one polypeptide molecule in said sample with a sequence selected from said group may further comprise determining the extent of specific binding of polypeptides in said sample to an antibody which binds specifically to a polypeptide comprising an amino acid sequence that is at least 90% identical to a sequence of at least 10 contiguous amino acids in a sequence selected from the group consisting of: an amino acid sequence of SEQ ID NO:Y wherein Y is any integer as defined in Table 1A; and a complete amino acid sequence of a protein encoded by a human cDNA clone identified by a cDNA Clone Identifier in Table 1A and contained in the deposit with the ATCC Deposit Number shown for said cDNA clone in Table 1A. Further, the step of comparing sequences in the above method may be performed by comparing the amino acid sequence determined from a polypeptide molecule in said sample with said sequence selected from said group.

Also preferred is a method for identifying the species, tissue or cell type of a biological sample which method comprises a step of detecting polypeptide molecules in said sample, if any, comprising an amino acid sequence that is at least 90% identical to a sequence of at least 10 contiguous amino acids in a sequence selected from the group consisting of: an amino acid sequence of SEQ ID NO:Y wherein Y is any integer as defined in Table 1A; and a complete amino acid sequence of a secreted protein encoded by a human cDNA clone identified by a cDNA Clone Identifier in Table 1A and contained in the deposit with the ATCC Deposit Number shown for said cDNA clone in Table 1A. This method may further comprise a step of detecting polypeptide molecules comprising an amino acid sequence in a panel of at least two amino acid sequences, wherein at least one sequence in said panel is at least 90% identical to a sequence of at least 10 contiguous amino acids in a sequence selected from the above group.

Also preferred is a method for diagnosing in a subject a pathological condition associated with abnormal structure or expression of a gene encoding a secreted protein identified in Table 1A, which method comprises a step of detecting in a biological sample obtained from said subject polypeptide molecules comprising an amino acid sequence in a panel of at least two amino acid sequences, wherein at least one sequence in said panel is at least 90% identical to a sequence of at least 10 contiguous amino acids in a sequence selected from the group consisting of: an amino acid sequence of SEQ ID NO:Y wherein Y is any integer as defined in Table 1A; and a complete amino acid sequence of a secreted protein encoded by a human cDNA clone identified by a cDNA Clone Identifier in Table 1A and contained in the deposit with the ATCC Deposit Number shown for said cDNA clone in Table 1A.

In any of these methods, the step of detecting said polypeptide molecules includes using an antibody.

Also preferred is an isolated nucleic acid molecule comprising a nucleotide sequence which is at least 95% identical to a nucleotide sequence encoding a polypeptide wherein said polypeptide comprises an amino acid sequence that is at least 90% identical to a sequence of at least 10 contiguous amino acids in a sequence selected from the group consisting of: an amino acid sequence of SEQ ID NO:Y wherein Y is any integer as defined in Table 1A; and a complete amino acid sequence of a secreted protein encoded by a human cDNA clone identified by a cDNA Clone Identifier in Table 1A and contained in the deposit with the ATCC Deposit Number shown for said cDNA clone in Table 1A. Further preferred is the above isolated nucleic acid molecule, wherein said nucleotide sequence encoding a polypeptide has been optimized for expression of said polypeptide in a prokaryotic host. Similarly preferred is the above isolated nucleic acid molecule, wherein said polypeptide comprises an amino acid sequence selected from the group consisting of: an amino acid sequence of SEQ ID NO:Y wherein Y is any integer as defined in Table 1A; and a complete amino acid sequence of a secreted protein encoded by a human cDNA clone identified by a cDNA Clone Identifier in Table 1A and contained in the deposit with the ATCC Deposit Number shown for said cDNA clone in Table 1A.

Further preferred is a method of making a recombinant vector comprising inserting any of the above isolated nucleic acid molecules into a vector. Also preferred is the recombinant vector produced by this method. Also preferred is a method of making a recombinant host cell comprising introducing the vector of the invention into a host cell, as well as the recombinant host cell produced by this method.

Also preferred is a method of making an isolated polypeptide comprising culturing this recombinant host cell under conditions such that said polypeptide is expressed and recovering said polypeptide. Also preferred is this method of making an isolated polypeptide, wherein said recombinant host cell is a eukaryotic cell and said polypeptide is a secreted portion of a human secreted protein comprising an amino acid sequence selected from the group consisting of: an amino acid sequence of SEQ ID NO:Y beginning with the residue at the position of the First Amino Acid of the Secreted Portion of SEQ ID NO:Y wherein Y is an integer set forth in Table 1A and said position of the First Amino Acid of the Secreted Portion of SEQ ID NO:Y is defined in Table 1A; and an amino acid sequence of a secreted portion of a protein encoded by a human cDNA clone identified by a cDNA Clone Identifier in Table 1A and contained in the deposit with the ATCC Deposit Number shown for said cDNA clone in Table 1A. The isolated polypeptide produced by this method is also preferred.

Also preferred is a method of treatment of an individual in need of an increased level of a secreted protein activity, which method comprises administering to such an individual a pharmaceutical composition comprising an amount of an isolated polypeptide, polynucleotide, or antibody of the claimed invention effective to increase the level of said protein activity in said individual.

Having generally described the invention, the same will be more readily understood by reference to the following examples, which are provided by way of illustration and are not intended as limiting.

The above-recited applications have uses in a wide variety of hosts. Such hosts include, but are not limited to, human, murine, rabbit, goat, guinea pig, camel, horse, mouse, rat, hamster, pig, micro-pig, chicken, goat, cow, sheep, dog, cat, non-human primate, and human. In specific embodiments, the host is a mouse, rabbit, goat, guinea pig, chicken, rat, hamster, pig, sheep, dog or cat. In preferred embodiments, the host is a mammal. In most preferred embodiments, the host is a human.

Having generally described the invention, the same will be more readily understood by reference to the following examples, which are provided by way of illustration and are not intended as limiting.

EXAMPLES

Example 1

Isolation of a Selected cDNA Clone From the Deposited Sample

Each cDNA clone in a cited ATCC deposit is contained in a plasmid vector. Table 1A identifies the vectors used to construct the cDNA library from which each clone was isolated. In many cases, the vector used to construct the library is a phage vector from which a plasmid has been excised. The table immediately below correlates the related plasmid for each phage vector used in constructing the cDNA library. For example, where a particular clone is identified in Table 1A as being isolated in the vector "Lambda Zap," the corresponding deposited clone is in "pBluescript."

| Vector Used to Construct Library | Corresponding Deposited Plasmid |
|---|---|
| Lambda Zap | pBluescript (pBS) |
| Uni-Zap XR | pBluescript (pBS) |
| Zap Express | pBK |
| lafmid BA | plafmid BA |

-continued

| Vector Used to Construct Library | Corresponding Deposited Plasmid |
|---|---|
| pSport1 | pSport1 |
| pCMVSport 2.0 | pCMVSport 2.0 |
| pCMVSport 3.0 | pCMVSport 3.0 |
| pCR ®2.1 | pCR ®2.1 |

Vectors Lambda Zap (U.S. Pat. Nos. 5,128,256 and 5,286,636), Uni-Zap XR (U.S. Pat. Nos. 5,128, 256 and 5,286,636), Zap Express (U.S. Pat. Nos. 5,128,256 and 5,286,636), pBluescript (pBS) (Short, J. M. et al., Nucleic Acids Res. 16:7583-7600 (1988); Alting-Mees, M. A. and Short, J. M., Nucleic Acids Res. 17:9494 (1989)) and pBK (Alting-Mees, M. A. et al., Strategies 5:58-61 (1992)) are commercially available from Stratagene Cloning Systems, Inc., 11011 N. Torrey Pines Road, La Jolla, Calif., 92037. pBS contains an ampicillin resistance gene and pBK contains a neomycin resistance gene. Both can be transformed into E. coli strain XL-1 Blue, also available from Stratagene. pBS comes in 4 forms SK+, SK−, KS+ and KS. The S and K refers to the orientation of the polylinker to the T7 and T3 primer sequences which flank the polylinker region ("S" is for SadI and "K" is for KpnI which are the first sites on each respective end of the linker). "+" or "−" refer to the orientation of the f1 origin of replication ("on"), such that in one orientation, single stranded rescue initiated from the f1 on generates sense strand DNA and in the other, antisense.

Vectors pSport1, pCMVSport 2.0 and pCMVSport 3.0, were obtained from Life Technologies, Inc., P. O. Box 6009, Gaithersburg, Md. 20897. All Sport vectors contain an ampicillin resistance gene and may be transformed into E. coli strain DH10B, also available from Life Technologies. (See, for instance, Gruber, C. E., et al., Focus 15:59 (1993).) Vector lafmid BA (Bento Soares, Columbia University, NY) contains an ampicillin resistance gene and can be transformed into E. coli strain XL-1 Blue. Vector pCR®2.1, which is available from Invitrogen, 1600 Faraday Avenue, Carlsbad, Calif. 92008, contains an ampicillin resistance gene and may be transformed into E. coli strain DH10B, available from Life Technologies. (See, for instance, Clark, J. M., Nuc. Acids Res. 16:9677-9686 (1988) and Mead, D. et al., Bio/Technology 9: (1991).) Preferably, a polynucleotide of the present invention does not comprise the phage vector sequences identified for the particular clone in Table 1A, as well as the corresponding plasmid vector sequences designated above.

The deposited material in the sample assigned the ATCC Deposit Number cited in Table 1A for any given cDNA clone also may contain one or more additional plasmids, each comprising a cDNA clone different from that given clone. Thus, deposits sharing the same ATCC Deposit Number contain at least a plasmid for each cDNA clone identified in Table 1A. Typically, each ATCC deposit sample cited in Table 1A comprises a mixture of approximately equal amounts (by weight) of about 50 plasmid DNAs, each containing a different cDNA clone; but such a deposit sample may include plasmids for more or less than 50 cDNA clones, up to about 500 cDNA clones.

Two approaches can be used to isolate a particular clone from the deposited sample of plasmid DNAs cited for that clone in Table 1A. First, a plasmid is directly isolated by screening the clones using a polynucleotide probe corresponding to SEQ ID NO:X.

Particularly, a specific polynucleotide with 30-40 nucleotides is synthesized using an Applied Biosystems DNA synthesizer according to the sequence reported. The oligonucleotide is labeled, for instance, with $^{32}$P-γ-ATP using T4 polynucleotide kinase and purified according to routine methods. (E.g., Maniatis et al., Molecular Cloning: A Laboratory Manual, Cold Spring Harbor Press, Cold Spring, N.Y. (1982).) The plasmid mixture is transformed into a suitable host, as indicated above (such as XL-1 Blue (Stratagene)) using techniques known to those of skill in the art, such as those provided by the vector supplier or in related publications or patents cited above. The transformants are plated on 1.5% agar plates (containing the appropriate selection agent, e.g., ampicillin) to a density of about 150 transformants (colonies) per plate. These plates are screened using Nylon membranes according to routine methods for bacterial colony screening (e.g., Sambrook et al., Molecular Cloning: A Laboratory Manual, 2nd Edit., (1989), Cold Spring Harbor Laboratory Press, pages 1.93 to 1.104), or other techniques known to those of skill in the art.

Alternatively, two primers of 17-20 nucleotides derived from both ends of the SEQ ID NO:X (i.e., within the region of SEQ ID NO:X bounded by the 5' NT and the 3' NT of the clone defined in Table 1A) are synthesized and used to amplify the desired cDNA using the deposited cDNA plasmid as a template. The polymerase chain reaction is carried out under routine conditions, for instance, in 25 ul of reaction mixture with 0.5 ug of the above cDNA template. A convenient reaction mixture is 1.5-5 mM $MgCl_2$, 0.01% (w/v) gelatin, 20 uM each of dATP, dCTP, dGTP, dTTP, 25 pmol of each primer and 0.25 Unit of Taq polymerase. Thirty five cycles of PCR (denaturation at 94 degree C. for 1 min; annealing at 55 degree C. for 1 min; elongation at 72 degree C. for 1 min) are performed with a Perkin-Elmer Cetus automated thermal cycler. The amplified product is analyzed by agarose gel electrophoresis and the DNA band with expected molecular weight is excised and purified. The PCR product is verified to be the selected sequence by subcloning and sequencing the DNA product.

Several methods are available for the identification of the 5' or 3' non-coding portions of a gene which may not be present in the deposited clone. These methods include but are not limited to, filter probing, clone enrichment using specific probes, and protocols similar or identical to 5' and 3' "RACE" protocols which are well known in the art. For instance, a method similar to 5' RACE is available for generating the missing 5' end of a desired full-length transcript. (Fromont-Racine et al., Nucleic Acids Res. 21(7):1683-1684 (1993).)

Briefly, a specific RNA oligonucleotide is ligated to the 5' ends of a population of RNA presumably containing full-length gene RNA transcripts. A primer set containing a primer specific to the ligated RNA oligonucleotide and a primer specific to a known sequence of the gene of interest is used to PCR amplify the 5' portion of the desired full-length gene. This amplified product may then be sequenced and used to generate the full length gene.

This above method starts with total RNA isolated from the desired source, although poly-A+ RNA can be used. The RNA preparation can then be treated with phosphatase if necessary to eliminate 5' phosphate groups on degraded or damaged RNA which may interfere with the later RNA ligase step. The phosphatase should then be inactivated and the RNA treated with tobacco acid pyrophosphatase in order to remove the cap structure present at the 5' ends of messenger RNAs. This reaction leaves a 5' phosphate group at the 5' end of the cap cleaved RNA which can then be ligated to an RNA oligonucleotide using T4 RNA ligase.

This modified RNA preparation is used as a template for first strand cDNA synthesis using a gene specific oligonucleotide. The first strand synthesis reaction is used as a template for PCR amplification of the desired 5' end using a primer specific to the ligated RNA oligonucleotide and a primer specific to the known sequence of the gene of interest. The resultant product is then sequenced and analyzed to confirm that the 5' end sequence belongs to the desired gene.

Example 2

Isolation of Genomic Clones Corresponding to a Polynucleotide

A human genomic P1 library (Genomic Systems, Inc.) is screened by PCR using primers selected for the cDNA sequence corresponding to SEQ ID NO:X., according to the method described in Example 1. (See also, Sambrook.)

Example 3

Tissue Specific Expression Analysis

The Human Genome Sciences, Inc. (HGS) database is derived from sequencing tissue specific cDNA libraries. Libraries generated from a particular tissue (e.g., colon cancer, or colon cancer) are selected and the specific tissue expression pattern of EST groups or assembled contigs within these libraries is determined by comparison of the expression patterns of those groups or contigs within the entire database. ESTs and assembled contigs which show tissue specific expression are selected.

The original clone from which the specific EST sequence was generated, or in the case of an assembled contig, the clone from which the 5' most EST sequence was generated, is obtained from the catalogued library of clones and the insert amplified by PCR using methods known in the art. The PCR product is denatured then transferred in 96 or 384 well format to a nylon membrane (Schleicher and Scheull) generating an array filter of tissue specific clones. Housekeeping genes, maize genes, and known tissue specific genes are included on the filters. These targets can be used in signal normalization and to validate assay sensitivity. Additional targets are included to monitor probe length and specificity of hybridization.

Radioactively labeled hybridization probes are generated by first strand cDNA synthesis per the manufacturer's instructions (Life Technologies) from mRNA/RNA samples prepared from the specific tissue being analyzed (e.g., colon, colon cancer, etc.). The hybridization probes are purified by gel exclusion chromatography, quantitated, and hybridized with the array filters in hybridization bottles at 65° C. overnight. The filters are washed under stringent conditions and signals are captured using a Fuji phosphorimager.

Data is extracted using AIS software and following background subtraction, signal normalization is performed. This includes a normalization of filter-wide expression levels between different experimental runs. Genes that are differentially expressed in the tissue of interest are identified and the full length sequence of these clones is generated.

Example 4

Chromosomal Mapping of the Polynucleotides

An oligonucleotide primer set is designed according to the sequence at the 5' end of SEQ ID NO:X. This primer preferably spans about 100 nucleotides. This primer set is then used in a polymerase chain reaction under the following set of conditions: 30 seconds, 95 degree C.; 1 minute, 56 degree C.;

1 minute, 70 degree C. This cycle is repeated 32 times followed by one 5 minute cycle at 70 degree C. Human, mouse, and hamster DNA is used as template in addition to a somatic cell hybrid panel containing individual chromosomes or chromosome fragments (Bios, Inc). The reactions is analyzed on either 8% polyacrylamide gels or 3.5 agarose gels. Chromosome mapping is determined by the presence of an approximately 100 by PCR fragment in the particular somatic cell hybrid.

Example 5

Bacterial Expression of a Polypeptide

A polynucleotide encoding a polypeptide of the present invention is amplified using PCR oligonucleotide primers corresponding to the 5' and 3' ends of the DNA sequence, as outlined in Example 1, to synthesize insertion fragments. The primers used to amplify the cDNA insert should preferably contain restriction sites, such as BamHI and XbaI, at the 5' end of the primers in order to clone the amplified product into the expression vector. For example, BamHI and XbaI correspond to the restriction enzyme sites on the bacterial expression vector pQE-9. (Qiagen, Inc., Chatsworth, Calif.). This plasmid vector encodes antibiotic resistance ($Amp^r$), a bacterial origin of replication (on), an IPTG-regulatable promoter/operator (P/O), a ribosome binding site (RBS), a 6-histidine tag (6-His), and restriction enzyme cloning sites.

The pQE-9 vector is digested with BamHI and XbaI and the amplified fragment is ligated into the pQE-9 vector maintaining the reading frame initiated at the bacterial RBS. The ligation mixture is then used to transform the *E. coli* strain M15/rep4 (Qiagen, Inc.) which contains multiple copies of the plasmid pREP4, which expresses the lad repressor and also confers kanamycin resistance (Kana). Transformants are identified by their ability to grow on LB plates and ampicillin/kanamycin resistant colonies are selected. Plasmid DNA is isolated and confirmed by restriction analysis.

Clones containing the desired constructs are grown overnight (O/N) in liquid culture in LB media supplemented with both Amp (100 ug/ml) and Kan (25 ug/ml). The O/N culture is used to inoculate a large culture at a ratio of 1:100 to 1:250. The cells are grown to an optical density 600 ($O.D.^{600}$) of between 0.4 and 0.6. IPTG (Isopropyl-B-D-thiogalacto pyranoside) is then added to a final concentration of 1 mM. IPTG induces by inactivating the lad repressor, clearing the P/O leading to increased gene expression.

Cells are grown for an extra 3 to 4 hours. Cells are then harvested by centrifugation (20 mins at 6000×g). The cell pellet is solubilized in the chaotropic agent 6 Molar Guanidine HCl by stirring for 3-4 hours at 4 degree C. The cell debris is removed by centrifugation, and the supernatant containing the polypeptide is loaded onto a nickel-nitrilo-triacetic acid ("Ni-NTA") affinity resin column (available from QIAGEN, Inc., supra). Proteins with a 6×His tag bind to the Ni-NTA resin with high affinity and can be purified in a simple one-step procedure (for details see: The QIAexpressionist (1995) QIAGEN, Inc., supra).

Briefly, the supernatant is loaded onto the column in 6 M guanidine-HCl, pH 8, the column is first washed with 10 volumes of 6 M guanidine-HCl, pH 8, then washed with 10 volumes of 6 M guanidine-HCl pH 6, and finally the polypeptide is eluted with 6 M guanidine-HCl, pH 5.

The purified protein is then renatured by dialyzing it against phosphate-buffered saline (PBS) or 50 mM Na-acetate, pH 6 buffer plus 200 mM NaCl. Alternatively, the protein can be successfully refolded while immobilized on the Ni-NTA column. The recommended conditions are as follows: renature using a linear 6M-1M urea gradient in 500 mM NaCl, 20% glycerol, 20 mM Tris/HCl pH 7.4, containing protease inhibitors. The renaturation should be performed over a period of 1.5 hours or more. After renaturation the proteins are eluted by the addition of 250 mM immidazole Immidazole is removed by a final dialyzing step against PBS or 50 mM sodium acetate pH 6 buffer plus 200 mM NaCl. The purified protein is stored at 4 degree C. or frozen at −80 degree C.

In addition to the above expression vector, the present invention further includes an expression vector comprising phage operator and promoter elements operatively linked to a polynucleotide of the present invention, called pHE4a. (ATCC Accession Number 209645, deposited on Feb. 25, 1998.) This vector contains: 1) a neomycinphosphotransferase gene as a selection marker, 2) an *E. coli* origin of replication, 3) a T5 phage promoter sequence, 4) two lac operator sequences, 5) a Shine-Delgarno sequence, and 6) the lactose operon repressor gene (lacIq). The origin of replication (oriC) is derived from pUC19 (LTI, Gaithersburg, Md.). The promoter sequence and operator sequences are made synthetically.

DNA can be inserted into the pHEa by restricting the vector with NdeI and XbaI, BamHI, XhoI, or Asp718, running the restricted product on a gel, and isolating the larger fragment (the stuffer fragment should be about 310 base pairs). The DNA insert is generated according to the PCR protocol described in Example 1, using PCR primers having restriction sites for NdeI (5' primer) and XbaI, BamHI, XhoI, or Asp718 (3' primer). The PCR insert is gel purified and restricted with compatible enzymes. The insert and vector are ligated according to standard protocols.

The engineered vector could easily be substituted in the above protocol to express protein in a bacterial system.

Example 6

Purification of a Polypeptide from an Inclusion Body

The following alternative method can be used to purify a polypeptide expressed in *E coli* when it is present in the form of inclusion bodies. Unless otherwise specified, all of the following steps are conducted at 4-10 degree C.

Upon completion of the production phase of the *E. coli* fermentation, the cell culture is cooled to 4-10 degree C. and the cells harvested by continuous centrifugation at 15,000 rpm (Heraeus Sepatech). On the basis of the expected yield of protein per unit weight of cell paste and the amount of purified protein required, an appropriate amount of cell paste, by weight, is suspended in a buffer solution containing 100 mM Tris, 50 mM EDTA, pH 7.4. The cells are dispersed to a homogeneous suspension using a high shear mixer.

The cells are then lysed by passing the solution through a microfluidizer (Microfluidics, Corp. or APV Gaulin, Inc.) twice at 4000-6000 psi. The homogenate is then mixed with NaCl solution to a final concentration of 0.5 M NaCl, followed by centrifugation at 7000×g for 15 min. The resultant pellet is washed again using 0.5M NaCl, 100 mM Tris, 50 mM EDTA, pH 7.4.

The resulting washed inclusion bodies are solubilized with 1.5 M guanidine hydrochloride (GuHCl) for 2-4 hours. After 7000×g centrifugation for 15 min., the pellet is discarded and the polypeptide containing supernatant is incubated at 4 degree C. overnight to allow further GuHCl extraction.

Following high speed centrifugation (30,000×g) to remove insoluble particles, the GuHCl solubilized protein is refolded by quickly mixing the GuHCl extract with 20 volumes of buffer containing 50 mM sodium, pH 4.5, 150 mM NaCl, 2 mM EDTA by vigorous stirring. The refolded diluted protein solution is kept at 4 degree C. without mixing for 12 hours prior to further purification steps.

To clarify the refolded polypeptide solution, a previously prepared tangential filtration unit equipped with 0.16 um membrane filter with appropriate surface area (e.g., Filtron), equilibrated with 40 mM sodium acetate, pH 6.0 is employed. The filtered sample is loaded onto a cation exchange resin (e.g., Poros HS-50, Perseptive Biosystems). The column is washed with 40 mM sodium acetate, pH 6.0 and eluted with 250 mM, 500 mM, 1000 mM, and 1500 mM NaCl in the same buffer, in a stepwise manner. The absorbance at 280 nm of the effluent is continuously monitored. Fractions are collected and further analyzed by SDS-PAGE.

Fractions containing the polypeptide are then pooled and mixed with 4 volumes of water. The diluted sample is then loaded onto a previously prepared set of tandem columns of strong anion (Poros HQ-50, Perseptive Biosystems) and weak anion (Poros CM-20, Perseptive Biosystems) exchange resins. The columns are equilibrated with 40 mM sodium acetate, pH 6.0. Both columns are washed with 40 mM sodium acetate, pH 6.0, 200 mM NaCl. The CM-20 column is then eluted using a 10 column volume linear gradient ranging from 0.2 M NaCl, 50 mM sodium acetate, pH 6.0 to 1.0 M NaCl, 50 mM sodium acetate, pH 6.5. Fractions are collected under constant $A_{280}$ monitoring of the effluent. Fractions containing the polypeptide (determined, for instance, by 16% SDS-PAGE) are then pooled.

The resultant polypeptide should exhibit greater than 95% purity after the above refolding and purification steps. No major contaminant bands should be observed from Commassie blue stained 16% SDS-PAGE gel when 5 ug of purified protein is loaded. The purified protein can also be tested for endotoxin/LPS contamination, and typically the LPS content is less than 0.1 ng/ml according to LAL assays.

Example 7

Cloning and Expression of a Polypeptide in a Baculovirus Expression System

In this example, the plasmid shuttle vector pA2 is used to insert a polynucleotide into a baculovirus to express a polypeptide. This expression vector contains the strong polyhedrin promoter of the *Autographa californica* nuclear polyhedrosis virus (AcMNPV) followed by convenient restriction sites such as BamHI, Xba I and Asp718. The polyadenylation site of the simian virus 40 ("SV40") is used for efficient polyadenylation. For easy selection of recombinant virus, the plasmid contains the beta-galactosidase gene from *E. coli* under control of a weak *Drosophila* promoter in the same orientation, followed by the polyadenylation signal of the polyhedrin gene. The inserted genes are flanked on both sides by viral sequences for cell-mediated homologous recombination with wild-type viral DNA to generate a viable virus that express the cloned polynucleotide.

Many other baculovirus vectors can be used in place of the vector above, such as pAc373, pVL941, and pAcIM1, as one skilled in the art would readily appreciate, as long as the construct provides appropriately located signals for transcription, translation, secretion and the like, including a signal peptide and an in-frame AUG as required. Such vectors are described, for instance, in Luckow et al., Virology 170:31-39 (1989).

Specifically, the cDNA sequence contained in the deposited clone, including the AUG initiation codon and the naturally associated leader sequence identified in Table 1A, is amplified using the PCR protocol described in Example 1. If the naturally occurring signal sequence is used to produce the secreted protein, the pA2 vector does not need a second signal peptide. Alternatively, the vector can be modified (pA2 GP) to include a baculovirus leader sequence, using the standard methods described in Summers et al., "A Manual of Methods for Baculovirus Vectors and Insect Cell Culture Procedures," Texas Agricultural Experimental Station Bulletin No. 1555 (1987).

The amplified fragment is isolated from a 1% agarose gel using a commercially available kit ("Geneclean," BIO 101 Inc., La Jolla, Calif.). The fragment then is digested with appropriate restriction enzymes and again purified on a 1% agarose gel.

The plasmid is digested with the corresponding restriction enzymes and optionally, can be dephosphorylated using calf intestinal phosphatase, using routine procedures known in the art. The DNA is then isolated from a 1% agarose gel using a commercially available kit ("Geneclean" BIO 101 Inc., La Jolla, Calif.).

The fragment and the dephosphorylated plasmid are ligated together with T4 DNA ligase. *E. coli* HB101 or other suitable *E. coli* hosts such as XL-1 Blue (Stratagene Cloning Systems, La Jolla, Calif.) cells are transformed with the ligation mixture and spread on culture plates. Bacteria containing the plasmid are identified by digesting DNA from individual colonies and analyzing the digestion product by gel electrophoresis. The sequence of the cloned fragment is confirmed by DNA sequencing.

Five ug of a plasmid containing the polynucleotide is co-transfected with 1.0 ug of a commercially available linearized baculovirus DNA ("BaculoGold™ baculovirus DNA", Pharmingen, San Diego, Calif.), using the lipofection method described by Feigner et al., Proc. Natl. Acad. Sci. USA 84:7413-7417 (1987). One ug of BaculoGold™ virus DNA and 5 ug of the plasmid are mixed in a sterile well of a microtiter plate containing 50 ul of serum-free Grace's medium (Life Technologies Inc., Gaithersburg, Md.). Afterwards, 10 ul Lipofectin plus 90 ul Grace's medium are added, mixed and incubated for 15 minutes at room temperature. Then the transfection mixture is added drop-wise to 519 insect cells (ATCC CRL 1711) seeded in a 35 mm tissue culture plate with 1 ml Grace's medium without serum. The plate is then incubated for 5 hours at 27 degrees C. The transfection solution is then removed from the plate and 1 ml of Grace's insect medium supplemented with 10% fetal calf serum is added. Cultivation is then continued at 27 degrees C. for four days.

After four days the supernatant is collected and a plaque assay is performed, as described by Summers and Smith, supra. An agarose gel with "Blue Gal" (Life Technologies Inc., Gaithersburg) is used to allow easy identification and isolation of gal-expressing clones, which produce blue-stained plaques. (A detailed description of a "plaque assay" of this type can also be found in the user's guide for insect cell culture and baculovirology distributed by Life Technologies Inc., Gaithersburg, page 9-10.) After appropriate incubation, blue stained plaques are picked with the tip of a micropipettor (e.g., Eppendorf). The agar containing the recombinant viruses is then resuspended in a microcentrifuge tube containing 200 ul of Grace's medium and the suspension containing the recombinant baculovirus is used to infect 519 cells seeded in 35 mm dishes. Four days later the supernatants of these culture dishes are harvested and then they are stored at 4 degree C.

To verify the expression of the polypeptide, Sf9 cells are grown in Grace's medium supplemented with 10% heat-inactivated FBS. The cells are infected with the recombinant baculovirus containing the polynucleotide at a multiplicity of infection ("MOI") of about 2. If radiolabeled proteins are desired, 6 hours later the medium is removed and is replaced with SF900 II medium minus methionine and cysteine (available from Life Technologies Inc., Rockville, Md.). After 42 hours, 5 uCi of $^{35}$S-methionine and 5 uCi $^{35}$S-cysteine (available from Amersham) are added. The cells are further incubated for 16 hours and then are harvested by centrifugation. The proteins in the supernatant as well as the intracellular proteins are analyzed by SDS-PAGE followed by autoradiography (if radiolabeled).

Microsequencing of the amino acid sequence of the amino terminus of purified protein may be used to determine the amino terminal sequence of the produced protein.

Example 8

Expression of a Polypeptide in Mammalian Cells

The polypeptide of the present invention can be expressed in a mammalian cell. A typical mammalian expression vector contains a promoter element, which mediates the initiation of transcription of mRNA, a protein coding sequence, and signals required for the termination of transcription and polyadenylation of the transcript. Additional elements include enhancers, Kozak sequences and intervening sequences flanked by donor and acceptor sites for RNA splicing. Highly efficient transcription is achieved with the early and late promoters from SV40, the long terminal repeats (LTRs) from Retroviruses, e.g., RSV, HTLVI, HIVI and the early promoter of the cytomegalovirus (CMV). However, cellular elements can also be used (e.g., the human actin promoter).

Suitable expression vectors for use in practicing the present invention include, for example, vectors such as pSVL and pMSG (Pharmacia, Uppsala, Sweden), pRSVcat (ATCC 37152), pSV2dhfr (ATCC 37146), pBC12MI (ATCC 67109), pCMVSport 2.0, and pCMVSport 3.0. Mammalian host cells that could be used include, human Hela, 293, H9 and Jurkat cells, mouse NIH3T3 and C127 cells, Cos 1, Cos 7 and CV1, quail QC1-3 cells, mouse L cells and Chinese hamster ovary (CHO) cells.

Alternatively, the polypeptide can be expressed in stable cell lines containing the polynucleotide integrated into a chromosome. The co-transfection with a selectable marker such as dhfr, gpt, neomycin, hygromycin allows the identification and isolation of the transfected cells.

The transfected gene can also be amplified to express large amounts of the encoded protein. The DHFR (dihydrofolate reductase) marker is useful in developing cell lines that carry several hundred or even several thousand copies of the gene of interest. (See, e.g., Alt, F. W., et al., J. Biol. Chem. 253:1357-1370 (1978); Hamlin, J. L. and Ma, C., Biochem. et Biophys. Acta, 1097:107-143 (1990); Page, M. J. and Sydenham, M. A., Biotechnology 9:64-68 (1991).) Another useful selection marker is the enzyme glutamine synthase (GS) (Murphy et al., Biochem J. 227:277-279 (1991); Bebbington et al., Bio/Technology 10:169-175 (1992). Using these markers, the mammalian cells are grown in selective medium and the cells with the highest resistance are selected. These cell lines contain the amplified gene(s) integrated into a chromosome. Chinese hamster ovary (CHO) and NSO cells are often used for the production of proteins.

Derivatives of the plasmid pSV2-dhfr (ATCC Accession No. 37146), the expression vectors pC4 (ATCC Accession No. 209646) and pC6 (ATCC Accession No. 209647) contain the strong promoter (LTR) of the Rous Sarcoma Virus (Cullen et al., Molecular and Cellular Biology, 438-447 (March, 1985)) plus a fragment of the CMV-enhancer (Boshart et al., Cell 41:521-530 (1985).) Multiple cloning sites, e.g., with the restriction enzyme cleavage sites BamHI, XbaT and Asp718, facilitate the cloning of the gene of interest. The vectors also contain the 3' intron, the polyadenylation and termination signal of the rat preproinsulin gene, and the mouse DHFR gene under control of the SV40 early promoter.

Specifically, the plasmid pC6, for example, is digested with appropriate restriction enzymes and then dephosphorylated using calf intestinal phosphates by procedures known in the art. The vector is then isolated from a 1% agarose gel.

A polynucleotide of the present invention is amplified according to the protocol outlined in Example 1. If the naturally occurring signal sequence is used to produce the secreted protein, the vector does not need a second signal peptide. Alternatively, if the naturally occurring signal sequence is not used, the vector can be modified to include a heterologous signal sequence. (See, e.g., WO 96/34891.)

The amplified fragment is isolated from a 1% agarose gel using a commercially available kit ("Geneclean," BIO 101 Inc., La Jolla, Calif.). The fragment then is digested with appropriate restriction enzymes and again purified on a 1% agarose gel.

The amplified fragment is then digested with the same restriction enzyme and purified on a 1% agarose gel. The isolated fragment and the dephosphorylated vector are then ligated with T4 DNA ligase. E. coli HB101 or XL-1 Blue cells are then transformed and bacteria are identified that contain the fragment inserted into plasmid pC6 using, for instance, restriction enzyme analysis.

Chinese hamster ovary cells lacking an active DHFR gene is used for transfection. Five µg of the expression plasmid pC6a pC4 is cotransfected with 0.5 ug of the plasmid pSVneo using lipofectin (Felgner et al., supra). The plasmid pSV2-neo contains a dominant selectable marker, the neo gene from Tn5 encoding an enzyme that confers resistance to a group of antibiotics including G418. The cells are seeded in alpha minus MEM supplemented with 1 mg/ml G418. After 2 days, the cells are trypsinized and seeded in hybridoma cloning plates (Greiner, Germany) in alpha minus MEM supplemented with 10, 25, or 50 ng/ml of metothrexate plus 1 mg/ml G418. After about 10-14 days single clones are trypsinized and then seeded in 6-well petri dishes or 10 ml flasks using different concentrations of methotrexate (50 nM, 100 nM, 200 nM, 400 nM, 800 nM). Clones growing at the highest concentrations of methotrexate are then transferred to new 6-well plates containing even higher concentrations of methotrexate (1 uM, 2 uM, 5 uM, 10 mM, 20 mM). The same procedure is repeated until clones are obtained which grow at a concentration of 100-200 uM. Expression of the desired gene product is analyzed, for instance, by SDS-PAGE and Western blot or by reversed phase HPLC analysis.

Example 9

Protein Fusions

The polypeptides of the present invention are preferably fused to other proteins. These fusion proteins can be used for a variety of applications. For example, fusion of the present polypeptides to His-tag, HA-tag, protein A, IgG domains, and maltose binding protein facilitates purification. (See Example 5; see also EP A 394,827; Traunecker, et al., Nature 331:84-86 (1988).) Similarly, fusion to IgG-1, IgG-3, and albumin increases the halflife time in vivo. Nuclear localization signals fused to the polypeptides of the present invention can target the protein to a specific subcellular localization, while covalent heterodimer or homodimers can increase or decrease the activity of a fusion protein. Fusion proteins can also create chimeric molecules having more than one function. Finally, fusion proteins can increase solubility and/or stability of the fused protein compared to the non-fused protein. All of the types of fusion proteins described above can be made by modifying the following protocol, which outlines the fusion of a polypeptide to an IgG molecule, or the protocol described in Example 5.

Briefly, the human Fc portion of the IgG molecule can be PCR amplified, using primers that span the 5' and 3' ends of the sequence described below. These primers also should have convenient restriction enzyme sites that will facilitate cloning into an expression vector, preferably a mammalian expression vector.

For example, if pC4 (Accession No. 209646) is used, the human Fc portion can be ligated into the BamHI cloning site. Note that the 3' BamHI site should be destroyed. Next, the vector containing the human Fc portion is re-restricted with BamHI, linearizing the vector, and a polynucleotide of the present invention, isolated by the PCR protocol described in Example 1, is ligated into this BamHI site. Note that the polynucleotide is cloned without a stop codon, otherwise a fusion protein will not be produced.

If the naturally occurring signal sequence is used to produce the secreted protein, pC4 does not need a second signal peptide. Alternatively, if the naturally occurring signal sequence is not used, the vector can be modified to include a heterologous signal sequence. (See, e.g., WO 96/34891.)

Human IgG Fc region:
GGGATCCGGAGCCCAAATCTTCTGA-CAAAACTCACACATGCCCACCGTGC-CCAGCACCTGAAT TCGAGGGTGCACCGTCAGTCT-TCCTCTTCCCCCCAAAACCCAAGGACACCCTCATG-ATCTCCCGGACTC CTGAGGTCACATGCGTGGTG-GTGGACGTAAGCCACGAAGACCCTGAG-GTCAAGTTCAACTGGTACGTG GACGGCGTGGAG-GTGCATAATGCCAAGACAAAGCCGCGGGAGGAGC-AGTACAACAGCACGTACCGTG TGGTCAGCGTCCT-CACCGTCCTGCACCAGGACTGGCT-GAATGGCAAGGAGTACAAGTGCAAGGTCTCC AACAAAGCCCTCCCAACCCCCATC-GAGAAAACCATCTCCAAAGC-CAAAGGGCAGCCCCGAGAACCAC AGGTGTACAC-CCTGCCCCCATCCCGGGATGAGCTGACCAAGAACC-AGGTCAGCCTGACCTGCCTGGTC AAAGGCTTC-TATCCAAGCGACATCGCCGTGGAGTGG-GAGAGCAATGGGCAGCCGGAGAACAACTACA AGACCACGCCTCCCGTGCTGGACTC-CGACGGCTCCTTCTTCCTCTACAG-CAAGCTCACCGTGGACAAGA GCAGGTGGCAG-CAGGGGAACGTCTTCTCATGCTCCGTGATGCATGA-GGCTCTGCACAACCACTACACG CAGAAGAGC-CTCTCCCTGTCTCCGGGTAAATGAGTGC-GACGGCCGCGACTCTAGAGGAT (SEQ ID NO:1)

Example 10

Production of an Antibody from a Polypeptide

The antibodies of the present invention can be prepared by a variety of methods. (See, Current Protocols, Chapter 2.) As one example of such methods, cells expressing a polypeptide of the present invention is administered to an animal to induce the production of sera containing polyclonal antibodies. In a preferred method, a preparation of the secreted protein is prepared and purified to render it substantially free of natural contaminants. Such a preparation is then introduced into an animal in order to produce polyclonal antisera of greater specific activity.

In the most preferred method, the antibodies of the present invention are monoclonal antibodies (or protein binding fragments thereof). Such monoclonal antibodies can be prepared using hybridoma technology. (Köhler et al., Nature 256:495 (1975); Köhler et al., Eur. J. Immunol. 6:511 (1976); Köhler et al., Eur. J. Immunol. 6:292 (1976); Hammerling et al., in: Monoclonal Antibodies and T-Cell Hybridomas, Elsevier, N.Y., pp. 563-681 (1981).) In general, such procedures involve immunizing an animal (preferably a mouse) with polypeptide or, more preferably, with a secreted polypeptide-expressing cell. Such cells may be cultured in any suitable tissue culture medium; however, it is preferable to culture cells in Earle's modified Eagle's medium supplemented with 10% fetal bovine serum (inactivated at about 56 degrees C.), and supplemented with about 10 g/l of nonessential amino acids, about 1,000 U/ml of penicillin, and about 100 ug/ml of streptomycin.

The splenocytes of such mice are extracted and fused with a suitable myeloma cell line. Any suitable myeloma cell line may be employed in accordance with the present invention; however, it is preferable to employ the parent myeloma cell line (SP2O), available from the ATCC. After fusion, the resulting hybridoma cells are selectively maintained in HAT medium, and then cloned by limiting dilution as described by Wands et al. (Gastroenterology 80:225-232 (1981).) The hybridoma cells obtained through such a selection are then assayed to identify clones which secrete antibodies capable of binding the polypeptide.

Alternatively, additional antibodies capable of binding to the polypeptide can be produced in a two-step procedure using anti-idiotypic antibodies. Such a method makes use of the fact that antibodies are themselves antigens, and therefore, it is possible to obtain an antibody which binds to a second antibody. In accordance with this method, protein specific antibodies are used to immunize an animal, preferably a mouse. The splenocytes of such an animal are then used to produce hybridoma cells, and the hybridoma cells are screened to identify clones which produce an antibody whose ability to bind to the protein-specific antibody can be blocked by the polypeptide. Such antibodies comprise anti-idiotypic antibodies to the protein-specific antibody and can be used to immunize an animal to induce formation of further protein-specific antibodies.

It will be appreciated that Fab and F(ab')2 and other fragments of the antibodies of the present invention may be used according to the methods disclosed herein. Such fragments are typically produced by proteolytic cleavage, using enzymes such as papain (to produce Fab fragments) or pepsin (to produce F(ab')2 fragments). Alternatively, secreted protein-binding fragments can be produced through the application of recombinant DNA technology or through synthetic chemistry.

For in vivo use of antibodies in humans, it may be preferable to use "humanized" chimeric monoclonal antibodies. Such antibodies can be produced using genetic constructs derived from hybridoma cells producing the monoclonal antibodies described above. Methods for producing chimeric antibodies are known in the art. (See, for review, Morrison, Science 229:1202 (1985); Oi et al., BioTechniques 4:214 (1986); Cabilly et al., U.S. Pat. No. 4,816,567; Taniguchi et al., EP 171496; Morrison et al., EP 173494; Neuberger et al., WO 8601533; Robinson et al., WO 8702671; Boulianne et al., Nature 312:643 (1984); Neuberger et al., Nature 314:268 (1985).)

Example 11

Production of Secreted Protein For High-Throughput Screening Assays

The following protocol produces a supernatant containing a polypeptide to be tested. This supernatant can then be used in the Screening Assays described herein.

First, dilute Poly-D-Lysine (644 587 Boehringer-Mannheim) stock solution (1 mg/ml in PBS) 1:20 in PBS (w/o calcium or magnesium 17-516F Biowhittaker) for a working solution of 50 ug/ml. Add 200 ul of this solution to each well (24 well plates) and incubate at RT for 20 minutes. Be sure to distribute the solution over each well (note: a 12-channel pipetter may be used with tips on every other channel). Aspirate off the Poly-D-Lysine solution and rinse with 1 ml PBS (Phosphate Buffered Saline). The PBS should remain in the well until just prior to plating the cells and plates may be poly-lysine coated in advance for up to two weeks.

Plate 293T cells (do not carry cells past P+20) at $2 \times 10^5$ cells/well in 0.5 ml DMEM (Dulbecco's Modified Eagle Medium)(with 4.5 G/L glucose and L-glutamine (12-604F Biowhittaker))/10% heat inactivated FBS(14-503F Biowhittaker)/1×Penstrep(17-602E Biowhittaker). Let the cells grow overnight.

The next day, mix together in a sterile solution basin: 300 ul Lipofectamine (18324-012 Gibco/BRL) and 5 ml Optimem I (31985070 Gibco/BRL)/96-well plate. With a small volume multi-channel pipetter, aliquot approximately 2 ug of an expression vector containing a polynucleotide insert, produced by the methods described in Examples 8 or 9, into an appropriately labeled 96-well round bottom plate. With a multi-channel pipetter, add 50 ul of the Lipofectamine/Optimem I mixture to each well. Pipette up and down gently to mix. Incubate at RT 15-45 minutes. After about 20 minutes, use a multi-channel pipetter to add 150 ul Optimem I to each well. As a control, one plate of vector DNA lacking an insert should be transfected with each set of transfections.

Preferably, the transfection should be performed by tag-teaming the following tasks. By tag-teaming, hands on time is cut in half, and the cells do not spend too much time on PBS. First, person A aspirates off the media from four 24-well plates of cells, and then person B rinses each well with 0.5-1 ml PBS. Person A then aspirates off PBS rinse, and person B, using a 12-channel pipetter with tips on every other channel, adds the 200 ul of DNA/Lipofectamine/Optimem I complex to the odd wells first, then to the even wells, to each row on the 24-well plates. Incubate at 37 degrees C. for 6 hours.

While cells are incubating, prepare appropriate media, either 1% BSA in DMEM with 1×penstrep, or CHO-5 media (116.6 mg/L of $CaCl_2$ (anhyd); 0.00130 mg/L $CuSO_4$-$5H_2O$; 0.050 mg/L of $Fe(NO_3)_{3-9}H_2O$; 0.417 mg/L of $FeSO_4$-$7H_2O$; 311.80 mg/L of Kcl; 28.64 mg/L of $MgCl_2$; 48.84 mg/L of $MgSO_4$; 6995.50 mg/L of NaCl; 2400.0 mg/L of $NaHCO_3$; 62.50 mg/L of $NaH_2PO_4$—$H_20$; 71.02 mg/L of $Na_2HPO4$; 0.4320 mg/L of $ZnSO_4$-$7H_2O$; 0.002 mg/L of Arachidonic Acid; 1.022 mg/L of Cholesterol; 0.070 mg/L of DL-alpha-Tocopherol-Acetate; 0.0520 mg/L of Linoleic Acid; 0.010 mg/L of Linolenic Acid; 0.010 mg/L of Myristic Acid; 0.010 mg/L of Oleic Acid; 0.010 mg/L of Palmitric Acid; 0.010 mg/L of Palmitic Acid; 100 mg/L of Pluronic F-68; 0.010 mg/L of Stearic Acid; 2.20 mg/L of Tween 80; 4551 mg/L of D-Glucose; 130.85 mg/ml of L-Alanine; 147.50 mg/ml of L-Arginine-HCL; 7.50 mg/ml of L-Asparagine-$H_2O$; 6.65 mg/ml of L-Aspartic Acid; 29.56 mg/ml of L-Cystine-2HCL-$H_2$0; 31.29 mg/ml of L-Cystine-2HCL; 7.35 mg/ml of L-Glutamic Acid; 365.0 mg/ml of L-Glutamine; 18.75 mg/ml of Glycine; 52.48 mg/ml of L-Histidine-HCL-$H_2O$; 106.97 mg/ml of L-Isoleucine; 111.45 mg/ml of L-Leucine; 163.75 mg/ml of L-Lysine HCL; 32.34 mg/ml of L-Methionine; 68.48 mg/ml of L-Phenylalainine; 40.0 mg/ml of L-Proline; 26.25 mg/ml of L-Serine; 101.05 mg/ml of L-Threonine; 19.22 mg/ml of L-Tryptophan; 91.79 mg/ml of L-Tryrosine-2Na-$2H_2O$; 99.65 mg/ml of L-Valine; 0.0035 mg/L of Biotin; 3.24 mg/L of D-Ca Pantothenate; 11.78 mg/L of Choline Chloride; 4.65 mg/L of Folic Acid; 15.60 mg/L of i-Inositol; 3.02 mg/L of Niacinamide; 3.00 mg/L of Pyridoxal HCL; 0.031 mg/L of Pyridoxine HCL; 0.319 mg/L of Riboflavin; 3.17 mg/L of Thiamine HCL; 0.365 mg/L of Thymidine; and 0.680 mg/L of Vitamin $B_{12}$; 25 mM of HEPES Buffer; 2.39 mg/L of Na Hypoxanthine; 0.105 mg/L of Lipoic Acid; 0.081 mg/L of Sodium Putrescine-2HCL; 55.0 mg/L of Sodium Pyruvate; 0.0067 mg/L of Sodium Selenite; 20 uM of Ethanolamine; 0.122 mg/L of Ferric Citrate; 41.70 mg/L of Methyl-B-Cyclodextrin complexed with Linoleic Acid; 33.33 mg/L of Methyl-B-Cyclodextrin complexed with Oleic Acid; and 10 mg/L of Methyl-B-Cyclodextrin complexed with Retinal) with 2 mm glutamine and 1×penstrep. (BSA (81-068-3 Bayer) 100 gm dissolved in 1 L DMEM for a 10% BSA stock solution). Filter the media and collect 50 ul for endotoxin assay in 15 ml polystyrene conical.

The transfection reaction is terminated, preferably by tag-teaming, at the end of the incubation period. Person A aspirates off the transfection media, while person B adds 1.5 ml appropriate media to each well. Incubate at 37 degrees C. for 45 or 72 hours depending on the media used: 1% BSA for 45 hours or CHO-5 for 72 hours.

On day four, using a 300 ul multichannel pipetter, aliquot 600 ul in one 1 ml deep well plate and the remaining supernatant into a 2 ml deep well. The supernatants from each well can then be used in the assays described in Examples 13-20.

It is specifically understood that when activity is obtained in any of the assays described below using a supernatant, the activity originates from either the polypeptide directly (e.g., as a secreted protein) or by the polypeptide inducing expression of other proteins, which are then secreted into the supernatant. Thus, the invention further provides a method of identifying the protein in the supernatant characterized by an activity in a particular assay.

Example 12

Construction of GAS Reporter Construct

One signal transduction pathway involved in the differentiation and proliferation of cells is called the Jaks-STATs pathway. Activated proteins in the Jaks-STATs pathway bind to gamma activation site "GAS" elements or interferon-sensitive responsive element ("ISRE"), located in the promoter of many genes. The binding of a protein to these elements alter the expression of the associated gene.

GAS and ISRE elements are recognized by a class of transcription factors called Signal Transducers and Activators of Transcription, or "STATs." There are six members of the STATs family. Stat1 and Stat3 are present in many cell types, as is Stat2 (as response to IFN-alpha is widespread). Stat4 is more restricted and is not in many cell types though it has been found in T helper class I, cells after treatment with IL-12. Stat5 was originally called mammary growth factor, but has been found at higher concentrations in other cells including myeloid cells. It can be activated in tissue culture cells by many cytokines.

The STATs are activated to translocate from the cytoplasm to the nucleus upon tyrosine phosphorylation by a set of kinases known as the Janus Kinase ("Jaks") family. Jaks represent a distinct family of soluble tyrosine kinases and include Tyk2, Jak1, Jak2, and Jak3. These kinases display significant sequence similarity and are generally catalytically inactive in resting cells.

The Jaks are activated by a wide range of receptors summarized in the Table below. (Adapted from review by Schidler and Darnell, Ann. Rev. Biochem. 64:621-51 (1995).) A cytokine receptor family, capable of activating Jaks, is divided into two groups: (a) Class 1 includes receptors for IL-2, IL-3, IL-4, IL-6, IL-7, IL-9, IL-11, IL-12, IL-15, Epo, PRL, GH, G-CSF, GM-CSF, LIF, CNTF, and thrombopoietin; and (b) Class 2 includes IFN-a, IFN-g, and IL-10. The Class 1 receptors share a conserved cysteine motif (a set of four conserved cysteines and one tryptophan) and a WSXWS motif (a membrane proximal region encoding Trp-Ser-Xxx-Trp-Ser (SEQ ID NO:2)).

Thus, on binding of a ligand to a receptor, Jaks are activated, which in turn activate STATs, which then translocate and bind to GAS elements. This entire process is encompassed in the Jaks-STATs signal transduction pathway.

Therefore, activation of the Jaks-STATs pathway, reflected by the binding of the GAS or the ISRE element, can be used to indicate proteins involved in the proliferation and differentiation of cells. For example, growth factors and cytokines are known to activate the Jaks-STATs pathway. (See Table below.) Thus, by using GAS elements linked to reporter molecules, activators of the Jaks-STATs pathway can be identified.

| JAKs Ligand | tyk2 | Jak1 | Jak2 | Jak3 | STATS | GAS(elements) or ISRE |
|---|---|---|---|---|---|---|
| IFN family | | | | | | |
| IFN-a/B | + | + | − | − | 1, 2, 3 | ISRE |
| IFN-g | | + | + | − | 1 | GAS (IRF1 > Lys6 > IFP) |
| I1-10 | + | ? | ? | − | 1, 3 | |
| gp130 family | | | | | | |
| IL-6 (Pleiotrophic) | + | + | + | ? | 1, 3 | GAS (IRF1 > Lys6 > IFP) |
| I1-11(Pleiotrophic) | ? | + | ? | ? | 1, 3 | |
| OnM(Pleiotrophic) | ? | + | + | ? | 1, 3 | |
| LIF(Pleiotrophic) | ? | + | ? | 1, 3 | | |
| CNTF(Pleiotrophic) | −/+ | + | + | ? | 1, 3 | |
| G-CSF(Pleiotrophic) | ? | + | ? | ? | 1, 3 | |
| IL-12(Pleiotrophic) | + | − | + | + | 1, 3 | |
| g-C family | | | | | | |
| IL-2 (lymphocytes) | − | + | − | + | 1, 3, 5 | GAS |
| IL-4 (lymph/myeloid) | − | + | − | + | 6 | GAS (IRF1 = IFP >> Ly6)(IgH) |
| IL-7 (lymphocytes) | − | + | − | + | 5 | GAS |
| IL-9 (lymphocytes) | − | + | − | + | 5 | GAS |
| IL-13 (lymphocyte) | − | + | ? | ? | 6 | GAS |
| IL-15 | ? | + | ? | + | 5 | GAS |
| gp140 family | | | | | | |
| IL-3 (myeloid) | − | − | + | − | 5 | GAS (IRF1 > IFP >> Ly6) |
| IL-5 (myeloid) | − | − | + | − | 5 | GAS |
| GM-CSF (myeloid) | − | − | + | − | 5 | GAS |
| Growth hormone family | | | | | | |
| GH | ? | − | + | − | 5 | |
| PRL | ? | +/− | + | − | 1, 3, 5 | |
| EPO | ? | − | + | − | 5 | GAS(B-CAS > IRF1 = IFP >> Ly6) |
| Receptor Tyrosine Kinases | | | | | | |
| EGF | ? | + | + | − | 1, 3 | GAS (IRF1) |
| PDGF | ? | + | + | − | 1, 3 | |
| CSF-1 | ? | + | + | − | 1, 3 | GAS (not IRF1) |

To construct a synthetic GAS containing promoter element, which is used in the Biological Assays described in Examples 13-14, a PCR based strategy is employed to generate a GAS-SV40 promoter sequence. The 5' primer contains four tandem copies of the GAS binding site found in the IRF1 promoter and previously demonstrated to bind STATs upon induction with a range of cytokines (Rothman et al., Immunity 1:457-468 (1994).), although other GAS or ISRE elements can be used instead. The 5' primer also contains 18 bp of sequence complementary to the SV40 early promoter sequence and is flanked with an XhoI site. The sequence of the 5' primer is:

5':GCGCCTCGAGATTTCCCCGAAATCTA-GATTTCCCCGAAATGATTTCCCCGAAATGATTTCCCCGAAATATCTGCCATCTCAATTAG:3' (SEQ ID NO:3)

The downstream primer is complementary to the SV40 promoter and is flanked with a Hind III site: 5':GCG-GCAAGCTTTTTGCAAAGCCTAGGC:3' (SEQ ID NO:4)

PCR amplification is performed using the SV40 promoter template present in the B-gal:promoter plasmid obtained from Clontech. The resulting PCR fragment is digested with XhoI/Hind III and subcloned into BLSK2-. (Stratagene.) Sequencing with forward and reverse primers confirms that the insert contains the following sequence:

5':
CTCGAGATTTCCCCGAAATCTAGATTTCCCCGAAAT-GATTTCCCCGAAATGATTTCCCCGAA ATATCTGC-CATCTCAATTAGTCAGCAACCATAGTC-CCGCCCCTAACTCCGCCCATCCCGCCCCTAACTC CGCCCAGTTCCGCCCATTCTCCGC-CCCATGGCTGACTAATTTTTTTATT-TATGCAGAGGCCGAGGCCG CCTCGGCCTCTGAGC-TATTCCAGAAGTAGTGAGGAGGCTTTTTTGGAGGC-CTAGGCTTTTGCAAAAAGCTT:3' (SEQ ID NO:5)

With this GAS promoter element linked to the SV40 promoter, a GAS: SEAP2 reporter construct is next engineered. Here, the reporter molecule is a secreted alkaline phosphatase, or "SEAP." Clearly, however, any reporter molecule can be instead of SEAP, in this or in any of the other Examples. Well known reporter molecules that can be used instead of SEAP include chloramphenicol acetyltransferase (CAT), luciferase, alkaline phosphatase, B-galactosidase, green fluorescent protein (GFP), or any protein detectable by an antibody.

The above sequence confirmed synthetic GAS-SV40 promoter element is subcloned into the pSEAP-Promoter vector obtained from Clontech using HindIII and XhoI, effectively replacing the SV40 promoter with the amplified GAS:SV40 promoter element, to create the GAS-SEAP vector. However, this vector does not contain a neomycin resistance gene, and therefore, is not preferred for mammalian expression systems.

Thus, in order to generate mammalian stable cell lines expressing the GAS-SEAP reporter, the GAS-SEAP cassette is removed from the GAS-SEAP vector using SalI and NotI, and inserted into a backbone vector containing the neomycin resistance gene, such as pGFP-1 (Clontech), using these restriction sites in the multiple cloning site, to create the GAS-SEAP/Neo vector. Once this vector is transfected into mammalian cells, this vector can then be used as a reporter molecule for GAS binding as described in Examples 13-14.

Other constructs can be made using the above description and replacing GAS with a different promoter sequence. For example, construction of reporter molecules containing NFK-B and EGR promoter sequences are described in Examples 15 and 16. However, many other promoters can be substituted using the protocols described in these Examples. For instance, SRE, IL-2, NFAT, or Osteocalcin promoters can be substituted, alone or in combination (e.g., GAS/NF-KB/EGR, GAS/NF-KB, IL-2/NFAT, or NF-KB/GAS). Similarly, other cell lines can be used to test reporter construct activity, such as HELA (epithelial), HUVEC (endothelial), Reh (B-cell), Saos-2 (osteoblast), HUVAC (aortic), or Cardiomyocyte.

Example 13

High-Throughput Screening Assay for T-cell Activity

The following protocol is used to assess T-cell activity by identifying factors, and determining whether supernate containing a polypeptide of the invention proliferates and/or differentiates T-cells. T-cell activity is assessed using the GAS/SEAP/Neo construct produced in Example 12. Thus, factors that increase SEAP activity indicate the ability to activate the Jaks-STATS signal transduction pathway. The T-cell used in this assay is Jurkat T-cells (ATCC Accession No. TIB-152), although Molt-3 cells (ATCC Accession No. CRL-1552) and Molt-4 cells (ATCC Accession No. CRL-1582) cells can also be used.

Jurkat T-cells are lymphoblastic CD4+ Th1 helper cells. In order to generate stable cell lines, approximately 2 million Jurkat cells are transfected with the GAS-SEAP/neo vector using DMRIE-C (Life Technologies)(transfection procedure described below). The transfected cells are seeded to a density of approximately 20,000 cells per well and transfectants resistant to 1 mg/ml genticin selected. Resistant colonies are expanded and then tested for their response to increasing concentrations of interferon gamma. The dose response of a selected clone is demonstrated.

Specifically, the following protocol will yield sufficient cells for 75 wells containing 200 ul of cells. Thus, it is either scaled up, or performed in multiple to generate sufficient cells for multiple 96 well plates. Jurkat cells are maintained in RPMI+10% serum with 1% Pen-Strep. Combine 2.5 mls of OPTI-MEM (Life Technologies) with 10 ug of plasmid DNA in a T25 flask. Add 2.5 ml OPTI-MEM containing 50 ul of DMRIE-C and incubate at room temperature for 15-45 mins.

During the incubation period, count cell concentration, spin down the required number of cells ($10^7$ per transfection), and resuspend in OPTI-MEM to a final concentration of $10^7$ cells/ml. Then add 1 ml of $1 \times 10^7$ cells in OPTI-MEM to T25 flask and incubate at 37 degrees C. for 6 hrs. After the incubation, add 10 ml of RPMI+15% serum.

The Jurkat:GAS-SEAP stable reporter lines are maintained in RPMI+10% serum, 1 mg/ml Genticin, and 1% Pen-Strep. These cells are treated with supernatants containing polypeptides of the invention and/or induced polypeptides of the invention as produced by the protocol described in Example 11.

On the day of treatment with the supernatant, the cells should be washed and resuspended in fresh RPMI+10% serum to a density of 500,000 cells per ml. The exact number of cells required will depend on the number of supernatants being screened. For one 96 well plate, approximately 10 million cells (for 10 plates, 100 million cells) are required.

Transfer the cells to a triangular reservoir boat, in order to dispense the cells into a 96 well dish, using a 12 channel pipette. Using a 12 channel pipette, transfer 200 ul of cells into each well (therefore adding 100,000 cells per well).

After all the plates have been seeded, 50 ul of the supernatants are transferred directly from the 96 well plate containing the supernatants into each well using a 12 channel pipette. In addition, a dose of exogenous interferon gamma (0.1, 1.0, 10 ng) is added to wells H9, H10, and H11 to serve as additional positive controls for the assay.

The 96 well dishes containing Jurkat cells treated with supernatants are placed in an incubator for 48 hrs (note: this time is variable between 48-72 hrs). 35 ul samples from each well are then transferred to an opaque 96 well plate using a 12 channel pipette. The opaque plates should be covered (using sellophene covers) and stored at—20 degrees C. until SEAP assays are performed according to Example 17. The plates containing the remaining treated cells are placed at 4 degrees C. and serve as a source of material for repeating the assay on a specific well if desired.

As a positive control, 100 Unit/ml interferon gamma can be used which is known to activate Jurkat T cells. Over 30 fold induction is typically observed in the positive control wells.

The above protocol may be used in the generation of both transient, as well as, stable transfected cells, which would be apparent to those of skill in the art.

Example 14

High-Throughput Screening Assay Identifying Myeloid Activity

The following protocol is used to assess myeloid activity by determining whether polypeptides of the invention proliferates and/or differentiates myeloid cells. Myeloid cell activity is assessed using the GAS/SEAP/Neo construct produced in Example 12. Thus, factors that increase SEAP activity indicate the ability to activate the Jaks-STATS signal transduction pathway. The myeloid cell used in this assay is U937, a pre-monocyte cell line, although TF-1, HL60, or KG1 can be used.

To transiently transfect U937 cells with the GAS/SEAP/Neo construct produced in Example 12, a DEAE-Dextran method (Kharbanda et. al., 1994, Cell Growth & Differentiation, 5:259-265) is used. First, harvest $2 \times 10e^7$ U937 cells and wash with PBS. The U937 cells are usually grown in RPMI 1640 medium containing 10% heat-inactivated fetal bovine serum (FBS) supplemented with 100 units/ml penicillin and 100 mg/ml streptomycin.

Next, suspend the cells in 1 ml of 20 mM Tris-HCl (pH 7.4) buffer containing 0.5 mg/ml DEAE-Dextran, 8 ug GAS-SEAP2 plasmid DNA, 140 mM NaCl, 5 mM KCl, 375 uM $Na_2HPO_4.7H_2O$, 1 mM $MgCl_2$, and 675 uM $CaCl_2$. Incubate at 37 degrees C. for 45 min.

Wash the cells with RPMI 1640 medium containing 10% FBS and then resuspend in 10 ml complete medium and incubate at 37 degrees C. for 36 hr. The GAS-SEAP/U937 stable cells are obtained by growing the cells in 400 ug/ml G418. The G418-free medium is used for routine growth but every one to two months, the cells should be re-grown in 400 ug/ml G418 for couple of passages.

These cells are tested by harvesting $1 \times 10^8$ cells (this is enough for ten 96-well plates assay) and wash with PBS. Suspend the cells in 200 ml above described growth medium, with a final density of $5 \times 10^5$ cells/ml. Plate 200 ul cells per well in the 96-well plate (or $1 \times 10^5$ cells/well).

Add 50 ul of the supernatant prepared by the protocol described in Example 11. Incubate at 37 degrees C. for 48 to 72 hr. As a positive control, 100 Unit/ml interferon gamma can be used which is known to activate U937 cells. Over 30 fold induction is typically observed in the positive control wells. SEAP assay the supernatant according to the protocol described in Example 17.

Example 15

High-Throughput Screening Assay Identifying Neuronal Activity

When cells undergo differentiation and proliferation, a group of genes are activated through many different signal transduction pathways. One of these genes, EGR1 (early growth response gene 1), is induced in various tissues and cell types upon activation. The promoter of EGR1 is responsible for such induction. Using the EGR1 promoter linked to reporter molecules, activation of cells can be assessed.

Particularly, the following protocol is used to assess neuronal activity in PC12 cell lines. PC12 cells (rat phenochromocytoma cells) are known to proliferate and/or differentiate by activation with a number of mitogens, such as TPA (tetradecanoyl phorbol acetate), NGF (nerve growth factor), and EGF (epidermal growth factor). The EGR1 gene expression is activated during this treatment. Thus, by stably transfecting PC12 cells with a construct containing an EGR promoter linked to SEAP reporter, activation of PC12 cells can be assessed.

The EGR/SEAP reporter construct can be assembled by the following protocol. The EGR-1 promoter sequence (−633 to +1)(Sakamoto K et al., Oncogene 6:867-871 (1991)) can be PCR amplified from human genomic DNA using the following primers:

5' GCGCTCGAGGGATGACAGCGATAGAACCCCGG-3' (SEQ ID NO:6)

5' GCGAAGCTTCGCGACTCCCCGGATCCGCCTC-3' (SEQ ID NO:7)

Using the GAS:SEAP/Neo vector produced in Example 12, EGR1 amplified product can then be inserted into this vector. Linearize the GAS:SEAP/Neo vector using restriction enzymes XhoI/HindIII, removing the GAS/SV40 stuffer. Restrict the EGR1 amplified product with these same enzymes. Ligate the vector and the EGR1 promoter.

To prepare 96 well-plates for cell culture, two mls of a coating solution (1:30 dilution of collagen type I (Upstate Biotech Inc. Cat#08-115) in 30% ethanol (filter sterilized)) is added per one 10 cm plate or 50 ml per well of the 96-well plate, and allowed to air dry for 2 hr.

PC12 cells are routinely grown in RPMI-1640 medium (Bio Whittaker) containing 10% horse serum (JRH BIOSCIENCES, Cat. # 12449-78P), 5% heat-inactivated fetal bovine serum (FBS) supplemented with 100 units/ml penicillin and 100 ug/ml streptomycin on a precoated 10 cm tissue culture dish. One to four split is done every three to four days. Cells are removed from the plates by scraping and resuspended with pipetting up and down for more than 15 times.

Transfect the EGR/SEAP/Neo construct into PC12 using the Lipofectamine protocol described in Example 11. EGR-SEAP/PC12 stable cells are obtained by growing the cells in 300 ug/ml G418. The G418-free medium is used for routine growth but every one to two months, the cells should be re-grown in 300 ug/ml G418 for couple of passages.

To assay for neuronal activity, a 10 cm plate with cells around 70 to 80% confluent is screened by removing the old medium. Wash the cells once with PBS (Phosphate buffered saline). Then starve the cells in low serum medium (RPMI-1640 containing 1% horse serum and 0.5% FBS with antibiotics) overnight.

The next morning, remove the medium and wash the cells with PBS. Scrape off the cells from the plate, suspend the cells well in 2 ml low serum medium. Count the cell number and add more low serum medium to reach final cell density as $5\times10^5$ cells/ml.

Add 200 ul of the cell suspension to each well of 96-well plate (equivalent to $1\times10^5$ cells/well). Add 50 ul supernatant produced by Example 11, 37° C. for 48 to 72 hr. As a positive control, a growth factor known to activate PC12 cells through EGR can be used, such as 50 ng/ul of Neuronal Growth Factor (NGF). Over fifty-fold induction of SEAP is typically seen in the positive control wells. SEAP assay the supernatant according to Example 17.

Example 16

High-Throughput Screening Assay for T-cell Activity

NF-KB (Nuclear Factor KB) is a transcription factor activated by a wide variety of agents including the inflammatory cytokines IL-1 and TNF, CD30 and CD40, lymphotoxin-alpha and lymphotoxin-beta, by exposure to LPS or thrombin, and by expression of certain viral gene products. As a transcription factor, NF-KB regulates the expression of genes involved in immune cell activation, control of apoptosis (NF-KB appears to shield cells from apoptosis), B and T-cell development, anti-viral and antimicrobial responses, and multiple stress responses.

In non-stimulated conditions, NF-KB is retained in the cytoplasm with I-KB (Inhibitor KB). However, upon stimulation, I— KB is phosphorylated and degraded, causing NF-KB to shuttle to the nucleus, thereby activating transcription of target genes. Target genes activated by NF-KB include IL-2, IL-6, GM-CSF, ICAM-1 and class 1 MHC.

Due to its central role and ability to respond to a range of stimuli, reporter constructs utilizing the NF-KB promoter element are used to screen the supernatants produced in Example 11. Activators or inhibitors of NF-KB would be useful in treating diseases. For example, inhibitors of NF-KB could be used to treat those diseases related to the acute or chronic activation of NF-KB, such as rheumatoid arthritis.

To construct a vector containing the NF-KB promoter element, a PCR based strategy is employed. The upstream primer contains four tandem copies of the NF-KB binding site (GGGGACTTTCCC) (SEQ ID NO:8), 18 by of sequence complementary to the 5' end of the SV40 early promoter sequence, and is flanked with an XhoI site:
5':GCGGCCTCGAGGGGACTTTCCCGGG-GACTTTCCGGGGACTTTCCGGGACTTTC-CATCCTGCC ATCTCAATTAG: 3' (SEQ ID NO:9)

The downstream primer is complementary to the 3' end of the SV40 promoter and is flanked with a Hind III site:
5': GCGGCAAGCTTTTTGCAAAGCCTAGGC: 3' (SEQ ID NO:4)

PCR amplification is performed using the SV40 promoter template present in the pB-gal:promoter plasmid obtained from Clontech. The resulting PCR fragment is digested with XhoI and Hind III and subcloned into BLSK2-. (Stratagene). Sequencing with the T7 and T3 primers confirms the insert contains the following sequence:
5':CTCGAGGGGACTTTCCCGGGGACTTTC-CGGGGACTTTCCGGGGACTTTCCATCTGCCATCTCA ATTAGTCAGCAACCATAGTCCCGC-CCCTAACTCCGCCCATCCCGC-CCCTAACTCCGCCCAGTTCCGCCC ATTCTCCGC-CCCATGGCTGACTAATTTTTTTTATTTATGCAGAGG-CCGAGGCCGCCTCGGCCTCTGAGCT ATTCCA-GAAGTAGTGAGGAGGCTTTTTTGGAGGC-CTAGGCTTTTGCAAAAAGCTT:3' (SEQ ID NO:10)

Next, replace the SV40 minimal promoter element present in the pSEAP2-promoter plasmid (Clontech) with this NF-KB/SV40 fragment using XhoI and HindIII. However, this vector does not contain a neomycin resistance gene, and therefore, is not preferred for mammalian expression systems.

In order to generate stable mammalian cell lines, the NF-KB/SV40/SEAP cassette is removed from the above NF-KB/SEAP vector using restriction enzymes SalI and NoII, and inserted into a vector containing neomycin resistance. Particularly, the NF-KB/SV40/SEAP cassette was inserted into pGFP-1 (Clontech), replacing the GFP gene, after restricting pGFP-1 with SalI and NotI.

Once NF-KB/SV40/SEAP/Neo vector is created, stable Jurkat T-cells are created and maintained according to the protocol described in Example 13. Similarly, the method for assaying supernatants with these stable Jurkat T-cells is also described in Example 13. As a positive control, exogenous TNF alpha (0.1, 1, 10 ng) is added to wells H9, H10, and H11, with a 5-10 fold activation typically observed.

Example 17

Assay for SEAP Activity

As a reporter molecule for the assays described in Examples 13-16, SEAP activity is assayed using the Tropix Phospho-light Kit (Cat. BP-400) according to the following general procedure. The Tropix Phospho-light Kit supplies the Dilution, Assay, and Reaction Buffers used below.

Prime a dispenser with the 2.5× Dilution Buffer and dispense 15 ul of 2.5× dilution buffer into Optiplates containing 35 ul of a supernatant. Seal the plates with a plastic sealer and incubate at 65 degree C. for 30 min. Separate the Optiplates to avoid uneven heating.

Cool the samples to room temperature for 15 minutes. Empty the dispenser and prime with the Assay Buffer. Add 50 ml Assay Buffer and incubate at room temperature 5 min. Empty the dispenser and prime with the Reaction Buffer (see the table below). Add 50 ul Reaction Buffer and incubate at room temperature for 20 minutes. Since the intensity of the chemiluminescent signal is time dependent, and it takes about 10 minutes to read 5 plates on luminometer, one should treat 5 plates at each time and start the second set 10 minutes later.

Read the relative light unit in the luminometer. Set H12 as blank, and print the results. An increase in chemiluminescence indicates reporter activity.

| Reaction Buffer Formulation: | | |
|---|---|---|
| # of plates | Rxn buffer diluent (ml) | CSPD (ml) |
| 10 | 60 | 3 |
| 11 | 65 | 3.25 |
| 12 | 70 | 3.5 |
| 13 | 75 | 3.75 |
| 14 | 80 | 4 |
| 15 | 85 | 4.25 |
| 16 | 90 | 4.5 |
| 17 | 95 | 4.75 |
| 18 | 100 | 5 |
| 19 | 105 | 5.25 |
| 20 | 110 | 5.5 |
| 21 | 115 | 5.75 |

-continued

Reaction Buffer Formulation:

| # of plates | Rxn buffer diluent (ml) | CSPD (ml) |
|---|---|---|
| 22 | 120 | 6 |
| 23 | 125 | 6.25 |
| 24 | 130 | 6.5 |
| 25 | 135 | 6.75 |
| 26 | 140 | 7 |
| 27 | 145 | 7.25 |
| 28 | 150 | 7.5 |
| 29 | 155 | 7.75 |
| 30 | 160 | 8 |
| 31 | 165 | 8.25 |
| 32 | 170 | 8.5 |
| 33 | 175 | 8.75 |
| 34 | 180 | 9 |
| 35 | 185 | 9.25 |
| 36 | 190 | 9.5 |
| 37 | 195 | 9.75 |
| 38 | 200 | 10 |
| 39 | 205 | 10.25 |
| 40 | 210 | 10.5 |
| 41 | 215 | 10.75 |
| 42 | 220 | 11 |
| 43 | 225 | 11.25 |
| 44 | 230 | 11.5 |
| 45 | 235 | 11.75 |
| 46 | 240 | 12 |
| 47 | 245 | 12.25 |
| 48 | 250 | 12.5 |
| 49 | 255 | 12.75 |
| 50 | 260 | 13 |

Example 18

High-Throughput Screening Assay Identifying Changes in Small Molecule Concentration and Membrane Permeability Binding of a ligand to a receptor is known to alter intracellular levels of small molecules, such as calcium, potassium, sodium, and pH, as well as alter membrane potential. These alterations can be measured in an assay to identify supernatants which bind to receptors of a particular cell. Although the following protocol describes an assay for calcium, this protocol can easily be modified to detect changes in potassium, sodium, pH, membrane potential, or any other small molecule which is detectable by a fluorescent probe.

The following assay uses Fluorometric Imaging Plate Reader ("FLIPR") to measure changes in fluorescent molecules (Molecular Probes) that bind small molecules. Clearly, any fluorescent molecule detecting a small molecule can be used instead of the calcium fluorescent molecule, fluo-4 (Molecular Probes, Inc.; catalog no. F-14202), used here.

For adherent cells, seed the cells at 10,000-20,000 cells/well in a Co-star black 96-well plate with clear bottom. The plate is incubated in a $CO_2$ incubator for 20 hours. The adherent cells are washed two times in Biotek washer with 200 ul of HBSS (Hank's Balanced Salt Solution) leaving 100 ul of buffer after the final wash.

A stock solution of 1 mg/ml fluo-4 is made in 10% pluronic acid DMSO. To load the cells with fluo-4, 50 ul of 12 ug/ml fluo-4 is added to each well. The plate is incubated at 37 degrees C. in a $CO_2$ incubator for 60 min. The plate is washed four times in the Biotek washer with HBSS leaving 100 ul of buffer.

For non-adherent cells, the cells are spun down from culture media. Cells are re-suspended to $2\text{-}5 \times 10^6$ cells/ml with HBSS in a 50-ml conical tube. 4 ul of 1 mg/ml fluo-4 solution in 10% pluronic acid DMSO is added to each ml of cell suspension. The tube is then placed in a 37 degrees C. water bath for 30-60 min. The cells are washed twice with HBSS, resuspended to $1 \times 10^6$ cells/ml, and dispensed into a microplate, 100 ul/well. The plate is centrifuged at 1000 rpm for 5 min. The plate is then washed once in Denley CellWash with 200 ul, followed by an aspiration step to 100 ul final volume.

For a non-cell based assay, each well contains a fluorescent molecule, such as fluo-4. The supernatant is added to the well, and a change in fluorescence is detected.

To measure the fluorescence of intracellular calcium, the FLIPR is set for the following parameters: (1) System gain is 300-800 mW; (2) Exposure time is 0.4 second; (3) Camera F/stop is F/2; (4) Excitation is 488 nm; (5) Emission is 530 nm; and (6). Sample addition is 50 ul. Increased emission at 530 nm indicates an extracellular signaling event which has resulted in an increase in the intracellular $Ca^{++}$ concentration.

Example 19

High-Throughput Screening Assay Identifying Tyrosine Kinase Activity

The Protein Tyrosine Kinases (PTK) represent a diverse group of transmembrane and cytoplasmic kinases. Within the Receptor Protein Tyrosine Kinase RPTK) group are receptors for a range of mitogenic and metabolic growth factors including the PDGF, FGF, EGF, NGF, HGF and Insulin receptor subfamilies. In addition there are a large family of RPTKs for which the corresponding ligand is unknown. Ligands for RPTKs include mainly secreted small proteins, but also membrane-bound and extracellular matrix proteins.

Activation of RPTK by ligands involves ligand-mediated receptor dimerization, resulting in transphosphorylation of the receptor subunits and activation of the cytoplasmic tyrosine kinases. The cytoplasmic tyrosine kinases include receptor associated tyrosine kinases of the src-family (e.g., src, yes, lck, lyn, fyn) and non-receptor linked and cytosolic protein tyrosine kinases, such as the Jak family, members of which mediate signal transduction triggered by the cytokine superfamily of receptors (e.g., the Interleukins, Interferons, GM-CSF, and Leptin).

Because of the wide range of known factors capable of stimulating tyrosine kinase activity, the identification of novel human secreted proteins capable of activating tyrosine kinase signal transduction pathways are of interest. Therefore, the following protocol is designed to identify those novel human secreted proteins capable of activating the tyrosine kinase signal transduction pathways.

Seed target cells (e.g., primary keratinocytes) at a density of approximately 25,000 cells per well in a 96 well Loprodyne Silent Screen Plates purchased from Nalge Nunc (Naperville, Ill.). The plates are sterilized with two 30 minute rinses with 100% ethanol, rinsed with water and dried overnight. Some plates are coated for 2 hr with 100 ml of cell culture grade type I collagen (50 mg/ml), gelatin (2%) or polylysine (50 mg/ml), all of which can be purchased from Sigma Chemicals (St. Louis, Mo.) or 10% Matrigel purchased from Becton Dickinson (Bedford, Mass.), or calf serum, rinsed with PBS and stored at 4 degree C. Cell growth on these plates is assayed by seeding 5,000 cells/well in growth medium and indirect quantitation of cell number through use of alamarBlue as described by the manufacturer Alamar Biosciences, Inc. (Sacramento, Calif.) after 48 hr. Falcon plate covers #3071 from Becton Dickinson (Bedford, Mass.) are used to cover the Loprodyne Silent Screen Plates.

Falcon Microtest III cell culture plates can also be used in some proliferation experiments.

To prepare extracts, A431 cells are seeded onto the nylon membranes of Loprodyne plates (20,000/200 ml/well) and cultured overnight in complete medium. Cells are quiesced by incubation in serum-free basal medium for 24 hr. After 5-20 minutes treatment with EGF (60 ng/ml) or 50 ul of the supernatant produced in Example 11, the medium was removed and 100 ml of extraction buffer ((20 mM HEPES pH 7.5, 0.15 M NaCl, 1% Triton X-100, 0.1% SDS, 2 mM Na3VO4, 2 mM Na4P2O7 and a cocktail of protease inhibitors (# 1836170) obtained from Boeheringer Mannheim (Indianapolis, Ind.) is added to each well and the plate is shaken on a rotating shaker for 5 minutes at 4 degrees C. The plate is then placed in a vacuum transfer manifold and the extract filtered through the 0.45 mm membrane bottoms of each well using house vacuum. Extracts are collected in a 96-well catch/assay plate in the bottom of the vacuum manifold and immediately placed on ice. To obtain extracts clarified by centrifugation, the content of each well, after detergent solubilization for 5 minutes, is removed and centrifuged for 15 minutes at 4 degrees C. at 16,000×g.

Test the filtered extracts for levels of tyrosine kinase activity. Although many methods of detecting tyrosine kinase activity are known, one method is described here.

Generally, the tyrosine kinase activity of a supernatant is evaluated by determining its ability to phosphorylate a tyrosine residue on a specific substrate (a biotinylated peptide). Biotinylated peptides that can be used for this purpose include PSK1 (corresponding to amino acids 6-20 of the cell division kinase cdc2-p34) and PSK2 (corresponding to amino acids 1-17 of gastrin). Both peptides are substrates for a range of tyrosine kinases and are available from Boehringer Mannheim.

The tyrosine kinase reaction is set up by adding the following components in order. First, add 10 ul of 5 uM Biotinylated Peptide, then 10 ul ATP/Mg$_{2+}$ (5 mM ATP/50 mM MgCl$_2$), then 10 ul of 5× Assay Buffer (40 mM imidazole hydrochloride, pH7.3, 40 mM beta-glycerophosphate, 1 mM EGTA, 100 mM MgCl$_2$, 5 mM MnCl$_2$, 0.5 mg/ml BSA), then 5 ul of Sodium Vanadate (1 mM), and then 5 ul of water. Mix the components gently and preincubate the reaction mix at 30 degrees C. for 2 min. Initial the reaction by adding 10 ul of the control enzyme or the filtered supernatant.

The tyrosine kinase assay reaction is then terminated by adding 10 ul of 120 mm EDTA and place the reactions on ice.

Tyrosine kinase activity is determined by transferring 50 ul aliquot of reaction mixture to a microtiter plate (MTP) module and incubating at 37 degrees C. for 20 min. This allows the streptavadin coated 96 well plate to associate with the biotinylated peptide. Wash the MTP module with 300 ul/well of PBS four times. Next add 75 ul of anti-phosphotyrosine antibody conjugated to horse radish peroxidase (anti-P-Tyr-POD (0.5 u/ml)) to each well and incubate at 37 degrees C. for one hour. Wash the well as above.

Next add 100 ul of peroxidase substrate solution (Boehringer Mannheim) and incubate at room temperature for at least 5 mins (up to 30 min). Measure the absorbance of the sample at 405 nm by using ELISA reader. The level of bound peroxidase activity is quantitated using an ELISA reader and reflects the level of tyrosine kinase activity.

Example 20

High-Throughput Screening Assay Identifying Phosphorylation Activity

As a potential alternative and/or compliment to the assay of protein tyrosine kinase activity described in Example 19, an assay which detects activation (phosphorylation) of major intracellular signal transduction intermediates can also be used. For example, as described below one particular assay can detect tyrosine phosphorylation of the Erk-1 and Erk-2 kinases. However, phosphorylation of other molecules, such as Raf, JNK, p38 MAP, Map kinase kinase (MEK), MEK kinase, Src, Muscle specific kinase (MuSK), IRAK, Tec, and Janus, as well as any other phosphoserine, phosphotyrosine, or phosphothreonine molecule, can be detected by substituting these molecules for Erk-1 or Erk-2 in the following assay.

Specifically, assay plates are made by coating the wells of a 96-well ELISA plate with 0.1 ml of protein G (1 ug/ml) for 2 hr at room temp, (RT). The plates are then rinsed with PBS and blocked with 3% BSA/PBS for 1 hr at RT. The protein G plates are then treated with 2 commercial monoclonal antibodies (100 ng/well) against Erk-1 and Erk-2 (1 hr at RT) (Santa Cruz Biotechnology). (To detect other molecules, this step can easily be modified by substituting a monoclonal antibody detecting any of the above described molecules.) After 3-5 rinses with PBS, the plates are stored at 4 degrees C. until use.

A431 cells are seeded at 20,000/well in a 96-well Loprodyne filterplate and cultured overnight in growth medium. The cells are then starved for 48 hr in basal medium (DMEM) and then treated with EGF (6 ng/well) or 50 ul of the supernatants obtained in Example 11 for 5-20 minutes. The cells are then solubilized and extracts filtered directly into the assay plate.

After incubation with the extract for 1 hr at RT, the wells are again rinsed. As a positive control, a commercial preparation of MAP kinase (10 ng/well) is used in place of A431 extract. Plates are then treated with a commercial polyclonal (rabbit) antibody (1 ug/ml) which specifically recognizes the phosphorylated epitope of the Erk-1 and Erk-2 kinases (1 hr at RT). This antibody is biotinylated by standard procedures. The bound polyclonal antibody is then quantitated by successive incubations with Europium-streptavidin and Europium fluorescence enhancing reagent in the Wallac DELFIA instrument (time-resolved fluorescence). An increased fluorescent signal over background indicates a phosphorylation.

Example 21

Method of Determining Alterations in a Gene Corresponding to a Polynucleotide

RNA isolated from entire families or individual patients presenting with a phenotype of interest (such as a disease) is be isolated. cDNA is then generated from these RNA samples using protocols known in the art. (See, Sambrook.) The cDNA is then used as a template for PCR, employing primers surrounding regions of interest in SEQ ID NO:X. Suggested PCR conditions consist of 35 cycles at 95 degrees C. for 30 seconds; 60-120 seconds at 52-58 degrees C.; and 60-120 seconds at 70 degrees C., using buffer solutions described in Sidransky et al., Science 252:706 (1991).

PCR products are then sequenced using primers labeled at their 5' end with T4 polynucleotide kinase, employing SequiTherm Polymerase. (Epicentre Technologies). The intron-exon borders of selected exons is also determined and genomic PCR products analyzed to confirm the results. PCR products harboring suspected mutations is then cloned and sequenced to validate the results of the direct sequencing.

PCR products is cloned into T-tailed vectors as described in Holton et al., Nucleic Acids Research, 19:1156 (1991) and sequenced with T7 polymerase (United States Biochemical). Affected individuals are identified by mutations not present in unaffected individuals.

Genomic rearrangements are also observed as a method of determining alterations in a gene corresponding to a polynucleotide. Genomic clones isolated according to Example 2 are nick-translated with digoxigenindeoxy-uridine 5'-triphosphate (Boehringer Manheim), and FISH performed as described in Johnson et al., Methods Cell Biol. 35:73-99 (1991). Hybridization with the labeled probe is carried out using a vast excess of human cot-1 DNA for specific hybridization to the corresponding genomic locus.

Chromosomes are counterstained with 4,6-diamino-2-phenylidole and propidium iodide, producing a combination of C- and R-bands. Aligned images for precise mapping are obtained using a triple-band filter set (Chroma Technology, Brattleboro, Vt.) in combination with a cooled charge-coupled device camera (Photometrics, Tucson, Ariz.) and variable excitation wavelength filters. (Johnson et al., Genet. Anal. Tech. Appl., 8:75 (1991).)

Image collection, analysis and chromosomal fractional length measurements are performed using the ISee Graphical Program System. (Inovision Corporation, Durham, N.C.) Chromosome alterations of the genomic region hybridized by the probe are identified as insertions, deletions, and translocations. These alterations are used as a diagnostic marker for an associated disease.

Example 22

Method of Detecting Abnormal Levels of a Polypeptide in a Biological Sample

A polypeptide of the present invention can be detected in a biological sample, and if an increased or decreased level of the polypeptide is detected, this polypeptide is a marker for a particular phenotype. Methods of detection are numerous, and thus, it is understood that one skilled in the art can modify the following assay to fit their particular needs.

For example, antibody-sandwich ELISAs are used to detect polypeptides in a sample, preferably a biological sample. Wells of a microtiter plate are coated with specific antibodies, at a final concentration of 0.2 to 10 ug/ml. The antibodies are either monoclonal or polyclonal and are produced by the method described in Example 10. The wells are blocked so that non-specific binding of the polypeptide to the well is reduced.

The coated wells are then incubated for >2 hours at RT with a sample containing the polypeptide. Preferably, serial dilutions of the sample should be used to validate results. The plates are then washed three times with deionized or distilled water to remove unbounded polypeptide.

Next, 50 ul of specific antibody-alkaline phosphatase conjugate, at a concentration of 25-400 ng, is added and incubated for 2 hours at room temperature. The plates are again washed three times with deionized or distilled water to remove unbounded conjugate.

Add 75 ul of 4-methylumbelliferyl phosphate (MUP) or p-nitrophenyl phosphate (NPP) substrate solution to each well and incubate 1 hour at room temperature. Measure the reaction by a microtiter plate reader. Prepare a standard curve, using serial dilutions of a control sample, and plot polypeptide concentration on the X-axis (log scale) and fluorescence or absorbance of the Y-axis (linear scale). Interpolate the concentration of the polypeptide in the sample using the standard curve.

Example 23

Formulation

The invention also provides methods of treatment and/or prevention of diseases or disorders (such as, for example, any one or more of the diseases or disorders disclosed herein) by administration to a subject of an effective amount of a Therapeutic. By therapeutic is meant polynucleotides or polypeptides of the invention (including fragments and variants), agonists or antagonists thereof, and/or antibodies thereto, in combination with a pharmaceutically acceptable carrier type (e.g., a sterile carrier).

The Therapeutic will be formulated and dosed in a fashion consistent with good medical practice, taking into account the clinical condition of the individual patient (especially the side effects of treatment with the Therapeutic alone), the site of delivery, the method of administration, the scheduling of administration, and other factors known to practitioners. The "effective amount" for purposes herein is thus determined by such considerations.

As a general proposition, the total pharmaceutically effective amount of the Therapeutic administered parenterally per dose will be in the range of about 1 ug/kg/day to 10 mg/kg/day of patient body weight, although, as noted above, this will be subject to therapeutic discretion. More preferably, this dose is at least 0.01 mg/kg/day, and most preferably for humans between about 0.01 and 1 mg/kg/day for the hormone. If given continuously, the Therapeutic is typically administered at a dose rate of about 1 ug/kg/hour to about 50 ug/kg/hour, either by 1-4 injections per day or by continuous subcutaneous infusions, for example, using a mini-pump. An intravenous bag solution may also be employed. The length of treatment needed to observe changes and the interval following treatment for responses to occur appears to vary depending on the desired effect.

Therapeutics can be are administered orally, rectally, parenterally, intracistemally, intravaginally, intraperitoneally, topically (as by powders, ointments, gels, drops or transdermal patch), bucally, or as an oral or nasal spray. "Pharmaceutically acceptable carrier" refers to a non-toxic solid, semisolid or liquid filler, diluent, encapsulating material or formulation auxiliary of any. The term "parenteral" as used herein refers to modes of administration which include intravenous, intramuscular, intraperitoneal, intrasternal, subcutaneous and intraarticular injection and infusion.

Therapeutics of the invention are also suitably administered by sustained-release systems. Suitable examples of sustained-release Therapeutics are administered orally, rectally, parenterally, intracistemally, intravaginally, intraperitoneally, topically (as by powders, ointments, gels, drops or transdermal patch), bucally, or as an oral or nasal spray. "Pharmaceutically acceptable carrier" refers to a non-toxic solid, semisolid or liquid filler, diluent, encapsulating material or formulation auxiliary of any type. The term "parenteral" as used herein refers to modes of administration which include intravenous, intramuscular, intraperitoneal, intrasternal, subcutaneous and intraarticular injection and infusion.

Therapeutics of the invention are also suitably administered by sustained-release systems. Suitable examples of sustained-release Therapeutics include suitable polymeric materials (such as, for example, semi-permeable polymer matrices in the form of shaped articles, e.g., films, or mirocapsules), suitable hydrophobic materials (for example as an emulsion in an acceptable oil) or ion exchange resins, and sparingly soluble derivatives (such as, for example, a sparingly soluble salt).

Sustained-release matrices include polylactides (U.S. Pat. No. 3,773,919, EP 58,481), copolymers of L-glutamic acid and gamma-ethyl-L-glutamate (Sidman et al., Biopolymers 22:547-556 (1983)), poly (2-hydroxyethyl methacrylate) (Langer et al., J. Biomed. Mater. Res. 15:167-277 (1981), and Langer, Chem. Tech. 12:98-105 (1982)), ethylene vinyl acetate (Langer et al., Id.) or poly-D-(−)-3-hydroxybutyric acid (EP 133,988).

In a preferred embodiment, Neutrokine-alpha and/or Neutrokine-alphaSV compositions of the invention are formulated in a biodegradable, polymeric drug delivery system, for example as described in U.S. Pat. Nos. 4,938,763; 5,278,201; 5,278,202; 5,324,519; 5,340,849; and 5,487,897 and in International Publication Numbers WO01/35929, WO00/24374, and WO00/06117 which are hereby incorporated by reference in their entirety. In specific preferred embodiments the Neutrokine-alpha and/or Neutrokine-alphaSV compositions of the invention are formulated using the ATRIGEL® Biodegradable System of Atrix Laboratories, Inc. (Fort Collins, Colo.).

Examples of biodegradable polymers which can be used in the formulation of Neutrokine-alpha and/or Neutrokine-alphaSV compositions, include but are not limited to, polylactides, polyglycolides, polycaprolactones, polyanhydrides, polyamides, polyurethanes, polyesteramides, polyorthoesters, polydioxanones, polyacetals, polyketals, polycarbonates, polyorthocarbonates, polyphosphazenes, polyhydroxybutyrates, polyhydroxyvalerates, polyalkylene oxalates, polyalkylene succinates, poly(malic acid), poly(amino acids), poly(methyl vinyl ether), poly(maleic anhydride), polyvinylpyrrolidone, polyethylene glycol, polyhydroxycellulose, chitin, chitosan, and copolymers, terpolymers, or combinations or mixtures of the above materials. The preferred polymers are those that have a lower degree of crystallization and are more hydrophobic. These polymers and copolymers are more soluble in the biocompatible solvents than the highly crystalline polymers such as polyglycolide and chitin which also have a high degree of hydrogen-bonding. Preferred materials with the desired solubility parameters are the polylactides, polycaprolactones, and copolymers of these with glycolide in which there are more amorphous regions to enhance solubility. In specific preferred embodiments, the biodegradable polymers which can be used in the formulation of Neutrokine-alpha and/or Neutrokine-alphaSV compositions are poly(lactide-co-glycolides). Polymer properties such as molecular weight, hydrophobicity, and lactide/glycolide ratio may be modified to obtain the desired drug Neutrokine-alpha and/or Neutrokine-alphaSV release profile (See, e.g., Ravivarapu et al., Journal of Pharmaceutical Sciences 89:732-741 (2000), which is hereby incorporated by refernce in its entirety).

It is also preferred that the solvent for the biodegradable polymer be non-toxic, water miscible, and otherwise biocompatible. Examples of such solvents include, but are not limted to, N-methyl-2-pyrrolidone, 2-pyrrolidone, C2 to C6 alkanols, C1 to C15 alchohols, dils, triols, and tetraols such as ethanol, glycerine propylene glycol, butanol; C3 to C15 alkyl ketones such as acetone, diethyl ketone and methyl ethyl ketone; C3 to C15 esters such as methyl acetate, ethyl acetate, ethyl lactate; alkyl ketones such as methyl ethyl ketone, C1 to C15 amides such as dimethylformamide, dimethylacetamide and caprolactam; C3 to C20 ethers such as tetrahydrofuran, or solketal; tweens, triacetin, propylene carbonate, decylmethylsulfoxide, dimethyl sulfoxide, oleic acid, 1-dodecylazacycloheptan-2-one, Other preferred solvents are benzyl alchohol, benzyl benzoate, dipropylene glycol, tributyrin, ethyl oleate, glycerin, glycofural, isopropyl myristate, isopropyl palmitate, oleic acid, polyethylene glycol, propylene carbonate, and triethyl citrate. The most preferred solvents are N-methyl-2-pyrrolidone, 2-pyrrolidone, dimethyl sulfoxide, triacetin, and propylene carbonate because of the solvating ability and their compatibility.

Additionally, formulations comprising Neutrokine-alpha and/or Neutrokine-alphaSV compositions and a biodegradable polymer may also include release-rate modification agents and/or pore-forming agents. Examples of release-rate modification agents include, but are not limited to, fatty acids, triglycerides, other like hydrophobic compounds, organic solvents, plasticizing compounds and hydrophilic compounds. Suitable release rate modification agents include, for example, esters of mono-, di-, and tricarboxylic acids, such as 2-ethoxyethyl acetate, methyl acetate, ethyl acetate, diethyl phthalate, dimethyl phthalate, dibutyl phthalate, dimethyl adipate, dimethyl succinate, dimethyl oxalate, dimethyl citrate, triethyl citrate, acetyl tributyl citrate, acetyl triethyl citrate, glycerol triacetate, di(n-butyl) sebecate, and the like; polyhydroxy alcohols, such as propylene glycol, polyethylene glycol, glycerin, sorbitol, and the like; fatty acids; triesters of glycerol, such as triglycerides, epoxidized soybean oil, and other epoxidized vegetable oils; sterols, such as cholesterol; alcohols, such as $C_6$-$C_{12}$ alkanols, 2-ethoxyethanol, and the like. The release rate modification agent may be used singly or in combination with other such agents. Suitable combinations of release rate modification agents include, but are not limited to, glycerin/propylene glycol, sorbitol/glycerine, ethylene oxide/propylene oxide, butylene glycol/adipic acid, and the like. Preferred release rate modification agents include, but are not limited to, dimethyl citrate, triethyl citrate, ethyl heptanoate, glycerin, and hexanediol. Suitable pore-forming agents that may be used in the polymer composition include, but are not limited to, sugars such as sucrose and dextrose, salts such as sodium chloride and sodium carbonate, polymers such as hydroxylpropylcellulose, carboxymethylcellulose, polyethylene glycol, and polyvinylpyrrolidone. Solid crystals that will provide a defined pore size, such as salt or sugar, are preferred.

In specific preferred embodiments the Neutrokine-alpha and/or Neutrokine-alphaSV compositions of the invention are formulated using the BEMA™ BioErodible Mucoadhesive System, MCA™ MucoCutaneous Absorption System, SMP™ Solvent MicroParticle System, or BCP™ BioCompatible Polymer System of Atrix Laboratories, Inc. (Fort Collins, Colo.).

Sustained-release Therapeutics also include liposomally entrapped Therapeutics of the invention (see generally, Langer, *Science* 249:1527-1533 (1990); Treat et al., in *Liposomes in the Therapy of Infectious Disease and Cancer*, Lopez-Berestein and Fidler (eds.), Liss, New York, pp. 317-327 and 353-365 (1989)). Liposomes containing the Therapeutic are prepared by methods known per se: DE 3,218,121; Epstein et al., Proc. Natl. Acad. Sci. (USA) 82:3688-3692 (1985); Hwang et al., Proc. Natl. Acad. Sci. (USA) 77:4030-

4034 (1980); EP 52,322; EP 36,676; EP 88,046; EP 143,949; EP 142,641; Japanese Pat. Appl. 83-118008; U.S. Pat. Nos. 4,485,045 and 4,544,545; and EP 102,324. Ordinarily, the liposomes are of the small (about 200-800 Angstroms) unilamellar type in which the lipid content is greater than about 30 mol. percent cholesterol, the selected proportion being adjusted for the optimal Therapeutic.

In yet an additional embodiment, the Therapeutics of the invention are delivered by way of a pump (see Langer, supra; Sefton, CRC Crit. Ref. Biomed. Eng. 14:201 (1987); Buchwald et al., Surgery 88:507 (1980); Saudek et al., N. Engl. J. Med. 321:574 (1989)).

Other controlled release systems are discussed in the review by Langer (*Science* 249:1527-1533 (1990)).

For parenteral administration, in one embodiment, the Therapeutic is formulated generally by mixing it at the desired degree of purity, in a unit dosage injectable form (solution, suspension, or emulsion), with a pharmaceutically acceptable carrier, i.e., one that is non-toxic to recipients at the dosages and concentrations employed and is compatible with other ingredients of the formulation. For example, the formulation preferably does not include oxidizing agents and other compounds that are known to be deleterious to the Therapeutic.

Generally, the formulations are prepared by contacting the Therapeutic uniformly and intimately with liquid carriers or finely divided solid carriers or both. Then, if necessary, the product is shaped into the desired formulation. Preferably the carrier is a parenteral carrier, more preferably a solution that is isotonic with the blood of the recipient. Examples of such carrier vehicles include water, saline, Ringer's solution, and dextrose solution. Non-aqueous vehicles such as fixed oils and ethyl oleate are also useful herein, as well as liposomes.

The carrier suitably contains minor amounts of additives such as substances that enhance isotonicity and chemical stability. Such materials are non-toxic to recipients at the dosages and concentrations employed, and include buffers such as phosphate, citrate, succinate, acetic acid, and other organic acids or their salts; antioxidants such as ascorbic acid; low molecular weight (less than about ten residues) polypeptides, e.g., polyarginine or tripeptides; proteins, such as serum albumin, gelatin, or immunoglobulins; hydrophilic polymers such as polyvinylpyrrolidone; amino acids, such as glycine, glutamic acid, aspartic acid, or arginine; monosaccharides, disaccharides, and other carbohydrates including cellulose or its derivatives, glucose, manose, or dextrins; chelating agents such as EDTA; sugar alcohols such as mannitol or sorbitol; counterions such as sodium; and/or nonionic surfactants such as polysorbates, poloxamers, or PEG.

The Therapeutic is typically formulated in such vehicles at a concentration of about 0.1 mg/ml to 100 mg/ml, preferably 1-10 mg/ml, at a pH of about 3 to 8. It will be understood that the use of certain of the foregoing excipients, carriers, or stabilizers will result in the formation of polypeptide salts.

Any pharmaceutical used for therapeutic administration can be sterile. Sterility is readily accomplished by filtration through sterile filtration membranes (e.g., 0.2 micron membranes). Therapeutics generally are placed into a container having a sterile access port, for example, an intravenous solution bag or vial having a stopper pierceable by a hypodermic injection needle.

Therapeutics ordinarily will be stored in unit or multi-dose containers, for example, sealed ampoules or vials, as an aqueous solution or as a lyophilized formulation for reconstitution. As an example of a lyophilized formulation, 10-ml vials are filled with 5 ml of sterile-filtered 1% (w/v) aqueous Therapeutic solution, and the resulting mixture is lyophilized. The infusion solution is prepared by reconstituting the lyophilized Therapeutic using bacteriostatic Water-for-Injection.

The invention also provides a pharmaceutical pack or kit comprising one or more containers filled with one or more of the ingredients of the Therapeutics of the invention. Associated with such container(s) can be a notice in the form prescribed by a governmental agency regulating the manufacture, use or sale of pharmaceuticals or biological products, which notice reflects approval by the agency of manufacture, use or sale for human administration. In addition, the Therapeutics may be employed in conjunction with other therapeutic compounds.

The Therapeutics of the invention may be administered alone or in combination with adjuvants. Adjuvants that may be administered with the Therapeutics of the invention include, but are not limited to, alum, alum plus deoxycholate (ImmunoAg), MTP-PE (Biocine Corp.), QS21 (Genentech, Inc.), BCG (e.g., THERACYS®), MPL and nonviable prepartions of *Corynebacterium parvum*. In a specific embodiment, Therapeutics of the invention are administered in combination with alum. In another specific embodiment, Therapeutics of the invention are administered in combination with QS-21. Further adjuvants that may be administered with the Therapeutics of the invention include, but are not limited to, Monophosphoryl lipid immunomodulator, Adju-Vax 100a, QS-21, QS-18, CRL1005, Aluminum salts, MF-59, and Virosomal adjuvant technology. Vaccines that may be administered with the Therapeutics of the invention include, but are not limited to, vaccines directed toward protection against MMR (measles, mumps, rubella), polio, varicella, tetanus/diptheria, hepatitis A, hepatitis B, haemophilus influenzae B, whooping cough, pneumonia, influenza, Lyme's Disease, rotavirus, cholera, yellow fever, Japanese encephalitis, poliomyelitis, rabies, typhoid fever, and pertussis. Combinations may be administered either concomitantly, e.g., as an admixture, separately but simultaneously or concurrently; or sequentially. This includes presentations in which the combined agents are administered together as a therapeutic mixture, and also procedures in which the combined agents are administered separately but simultaneously, e.g., as through separate intravenous lines into the same individual. Administration "in combination" further includes the separate administration of one of the compounds or agents given first, followed by the second.

The Therapeutics of the invention may be administered alone or in combination with other therapeutic agents. Therapeutic agents that may be administered in combination with the Therapeutics of the invention, include but not limited to, chemotherapeutic agents, antibiotics, steroidal and non-steroidal anti-inflammatories, conventional immunotherapeutic agents, and/or therapeutic treatments described below. Combinations may be administered either concomitantly, e.g., as an admixture, separately but simultaneously or concurrently; or sequentially. This includes presentations in which the combined agents are administered together as a therapeutic mixture, and also procedures in which the combined agents are administered separately but simultaneously, e.g., as through separate intravenous lines into the same individual. Administration "in combination" further includes the separate administration of one of the compounds or agents given first, followed by the second.

In certain embodiments, Therapeutics of the invention are administered in combination with antiretroviral agents, nucleoside/nucleotide reverse transcriptase inhibitors (NRTIs), non-nucleoside reverse transcriptase inhibitors (NNRTIs), and/or protease inhibitors (PIs). NRTIs that may be administered in combination with the Therapeutics of the invention, include, but are not limited to, RETROVIR™ (zidovudine/AZT), VIDEX™ (didanosine/ddI), HIVID™ (zalcitabine/ddC), ZERIT™ (stavudine/d4T), EPIVIR™ (lamivudine/3TC), and COMBIVIR™ (zidovudine/lamivudine). NNRTIs that may be administered in combination with the Therapeutics of the invention, include, but are not limited to, VIRAMUNE™ (nevirapine), RESCRIPTOR™ (delavirdine), and SUSTIVA™ (efavirenz). Protease inhibitors that may be administered in combination with the Therapeutics of the invention, include, but are not limited to, CRIXIVAN™ (indinavir), NORVIR™ (ritonavir), INVIRASE™ (saquinavir), and VIRACEPT™ (nelfinavir). In a specific embodiment, antiretroviral agents, nucleoside reverse transcriptase inhibitors, non-nucleoside reverse transcriptase inhibitors, and/or protease inhibitors may be used in any combination with Therapeutics of the invention to treat AIDS and/or to prevent or treat HIV infection.

Additional NRTIs include LODENOSINE™ (F-ddA; an acid-stable adenosine NRTI; Triangle/Abbott; COVIRACIL™ (emtricitabine/FTC; structurally related to lamivudine (3TC) but with 3- to 10-fold greater activity in vitro; Triangle/Abbott); dOTC (BCH-10652, also structurally related to lamivudine but retains activity against a substantial proportion of lamivudine-resistant isolates; Biochem Pharma); Adefovir (refused approval for anti-HIV therapy by FDA; Gilead Sciences); PREVEON® (Adefovir Dipivoxil, the active prodrug of adefovir; its active form is PMEA-pp); TENOFOVIR™(bis-POC PMPA, a PMPA prodrug; Gilead); DAPD/DXG (active metabolite of DAPD; Triangle/Abbott); D-D4FC (related to 3TC, with activity against AZT/3TC-resistant virus); GW420867X (Glaxo Wellcome); ZIAGEN™ (abacavir/159U89; Glaxo Wellcome Inc.); CS-87 (3' azido-2',3'-dideoxyuridine; WO 99/66936); and S-acyl-2-thioethyl (SATE)-bearing prodrug forms of β-L-FD4C and β-L-FddC (WO 98/17281).

Additional NNRTIs include COACTINONT™ (Emivirine/MKC-442, potent NNRTI of the HEPT class; Triangle/Abbott); CAPRAVIRINE™ (AG-1549/S-1153, a next generation NNRTI with activity against viruses containing the K103N mutation; Agouron); PNU-142721 (has 20- to 50-fold greater activity than its predecessor delavirdine and is active against K103N mutants; Pharmacia & Upjohn); DPC-961 and DPC-963 (second-generation derivatives of efavirenz, designed to be active against viruses with the K103N mutation; DuPont); GW-420867x(has 25-fold greater activity than HBY097 and is active against K103N mutants; Glaxo Wellcome); CALANOLIDE A (naturally occurring agent from the latex tree; active against viruses containing either or both the Y181C and K103N mutations); and Propolis (WO 99/49830).

Additional protease inhibitors include LOPINAVIR™ (ABT378/r; Abbott Laboratories); BMS-232632 (an azapeptide; Bristol-Myres Squibb); TIPRANAVIR™ (PNU-140690, a non-peptic dihydropyrone; Pharmacia & Upjohn); PD-178390 (a nonpeptidic dihydropyrone; Parke-Davis); BMS 232632 (an azapeptide; Bristol-Myers Squibb); L-756, 423 (an indinavir analog; Merck); DMP-450 (a cyclic urea compound; Avid & DuPont); AG-1776 (a peptidomimetic with in vitro activity against protease inhibitor-resistant viruses; Agouron); VX-175/GW-433908 (phosphate prodrug of amprenavir; Vertex & Glaxo Welcome); CGP61755 (Ciba); and AGENERASE™ (amprenavir; Glaxo Wellcome Inc.).

Additional antiretroviral agents include fusion inhibitors/gp41 binders. Fusion inhibitors/gp41 binders include T-20 (a peptide from residues 643-678 of the HIV gp41 transmembrane protein ectodomain which binds to gp41 in its resting state and prevents transformation to the fusogenic state; Trimeris) and T-1249 (a second-generation fusion inhibitor; Trimeris).

Additional antiretroviral agents include fusion inhibitors/chemokine receptor antagonists. Fusion inhibitors/chemokine receptor antagonists include CXCR4 antagonists such as AMD 3100 (a bicyclam), SDF-1 and its analogs, and ALX40-4C (a cationic peptide), T22 (an 18 amino acid peptide; Trimeris) and the T22 analogs T134 and T140; CCR5 antagonists such as RANTES (9-68), AOP-RANTES, NNY-RANTES, and TAK-779; and CCR5/CXCR4 antagonists such as NSC 651016 (a distamycin analog). Also included are CCR2B, CCR3, and CCR6 antagonists. Chemokine recpetor agonists such as RANTES, SDF-1, MIP-1α, MIP-1β, etc., may also inhibit fusion.

Additional antiretroviral agents include integrase inhibitors. Integrase inhibitors include dicaffeoylquinic (DFQA) acids; L-chicoric acid (a dicaffeoyltartaric (DCTA) acid); quinalizarin (QLC) and related anthraquinones; ZINTEVIRT™ (AR 177, an oligonucleotide that probably acts at cell surface rather than being a true integrase inhibitor; Arondex); and naphthols such as those disclosed in WO 98/50347.

Additional antiretroviral agents include hydroxyurea-like compounds such as BCX-34 (a purine nucleoside phosphorylase inhibitor; Biocryst); ribonucleotide reductase inhibitors such as DIDOX™ (Molecules for Health); inosine monophosphate dehydrogenase (IMPDH) inhibitors sucha as VX-497 (Vertex); and mycopholic acids such as CellCept (mycophenolate mofetil; Roche).

Additional antiretroviral agents include inhibitors of viral integrase, inhibitors of viral genome nuclear translocation such as arylene bis(methylketone) compounds; inhibitors of HW entry such as AOP-RANTES, NNY-RANTES, RANTES-IgG fusion protein, soluble complexes of RANTES and glycosaminoglycans (GAG), and AMD-3100; nucleocapsid zinc finger inhibitors such as dithiane compounds; targets of HIV Tat and Rev; and pharmacoenhancers such as ABT-378.

Other antiretroviral therapies and adjunct therapies include cytokines and lymphokines such as MIP-1α, MIP-1β, SDF-1α, IL-2, PROLEUKIN™ (aldesleukin/L2-7001; Chiron), IL-4, IL-10, IL-12, and IL-13; interferons such as IFN-α2a; antagonists of TNFs, NFκB, GM-CSF, M-CSF, and IL-10; agents that modulate immune activation such as cyclosporin and prednisone; vaccines such as Remune™ (HIV Immunogen), APL 400-003 (Apollon), recombinant gp120 and fragments, bivalent (B/E) recombinant envelope glycoprotein, rgp120CM235, MN rgp120, SF-2 rgp120, gp120/soluble CD4 complex, Delta JR-FL protein, branched synthetic peptide derived from discontinuous gp120 C3/C4 domain, fusion-competent immunogens, and Gag, Pol, Nef, and Tat vaccines; gene-based therapies such as genetic suppressor elements (GSEs; WO 98/54366), and intrakines (genetically modified CC chemokines targetted to the ER to block surface expression of newly synthesized CCR5 (Yang et al., *PNAS* 94:11567-72 (1997); Chen et al., *Nat. Med.* 3:1110-16 (1997)); antibodies such as the anti-CXCR4 antibody 12G5, the anti-CCR5 antibodies 2D7, 5C7, PA8, PA9, PA10, PA11, PA12, and PA14, the anti-CD4 antibodies Q4120 and RPA-T4, the anti-CCR3 antibody 7B11, the anti-gp120 antibodies 17b, 48d, 447-52D, 257-D, 268-D and 50.1, anti-Tat antibodies, anti-TNF-α antibodies, and monoclonal antibody 33A; aryl hydrocarbon (AH) receptor agonists and antagonists such as TCDD, 3,3',4,4',5-pentachlorobiphenyl, 3,3',4,4'-tetrachlorobiphenyl, and α-naphthoflavone (WO 98/30213); and antioxidants such as γ-L-glutamyl-L-cysteine ethyl ester (γ-GCE; WO 99/56764).

In a further embodiment, the Therapeutics of the invention are administered in combination with an antiviral agent. Antiviral agents that may be administered with the Therapeutics of the invention include, but are not limited to, acyclovir, ribavirin, amantadine, and remantidine.

In other embodiments, Therapeutics of the invention may be administered in combination with anti-opportunistic infection agents. Anti-opportunistic agents that may be administered in combination with the Therapeutics of the invention, include, but are not limited to, TRIMETHOPRIM-SULFAMETHOXAZOLET™, DAPSONE™, PENTAMIDINE™, ATOVAQUONE™, ISONIAZID™, RIFAMPIN™, PYRAZINAMIDET™, ETHAMBUTOL™, RIFABUTIN™, CLARITHROMYCIN™, AZITHROMYCIN™, GANCICLOVIR™ FOSCARNET™, CIDOFOVIR™, FLUCONAZOLE™, ITRACONAZOLE™, KETOCONAZOLET™, ACYCLOVIR™, FAMCICOLVIR™, PYRIMETHAMINET™, LEUCOVORIN™, NEUPOGEN™ (filgrastim/G-CSF), and LEUKINE™ (sargramostim/GM-CSF). In a specific embodiment, Therapeutics of the invention are used in any combination with TRIMETHOPRIM-SULFAMETHOXAZOLET™, DAPSONE™, PENTAMIDINET™, and/or ATOVAQUONE™ to prophylactically treat or prevent an opportunistic *Pneumocystis carinii* pneumonia infection. In another specific embodiment, Therapeutics of the invention are used in any combination with ISONIAZID™ RIFAMPINT™, PYRAZINAMIDET™, and/or ETHAMBUTOL™ to prophylactically treat or prevent an opportunistic *Mycobacterium avium* complex infection. In another specific embodiment, Therapeutics of the invention are used in any combination with RIFABUTINT™, CLARITHROMYCINT™, and/or AZITHROMYCINT™ to prophylactically treat or prevent an opportunistic *Mycobacterium tuberculosis* infection. In another specific embodiment, Therapeutics of the invention are used in any combination with GANCICLOVIR™, FOSCARNET™, and/or CIDOFOVIR™ to prophylactically treat or prevent an opportunistic cytomegalovirus infection. In another specific embodiment, Therapeutics of the invention are used in any combination with FLUCONAZOLE™ ITRACONAZOLE™, and/or KETOCONAZOLE™ to prophylactically treat or prevent an opportunistic fungal infection. In another specific embodiment, Therapeutics of the invention are used in any combination with ACYCLOVIR™ and/or FAMCICOLVIR™ to prophylactically treat or prevent an opportunistic herpes simplex virus type I and/or type II infection. In another specific embodiment, Therapeutics of the invention are used in any combination with PYRIMETHAMINET™ and/or LEUCOVORIN™ to prophylactically treat or prevent an opportunistic *Toxoplasma gondii* infection. In another specific embodiment, Therapeutics of the invention are used in any combination with LEUCOVORIN™ and/or NEUPOGEN™ to prophylactically treat or prevent an opportunistic bacterial infection.

In a further embodiment, the Therapeutics of the invention are administered in combination with an antibiotic agent. Antibiotic agents that may be administered with the Therapeutics of the invention include, but are not limited to, amoxicillin, beta-lactamases, aminoglycosides, beta-lactam (glycopeptide), beta-lactamases, Clindamycin, chloramphenicol, cephalosporins, ciprofloxacin, erythromycin, fluoroquinolones, macrolides, metronidazole, penicillins, quinolones, rapamycin, rifampin, streptomycin, sulfonamide, tetracyclines, trimethoprim, trimethoprim-sulfamethoxazole, and vancomycin.

In other embodiments, Therapeutics of the invention are administered in combination with immunosuppressive agents. Immunosuppressive agents that may be administered in combination with the Therapeutics of the invention include, but are not limited to, steroids, cyclosporine, cyclosporine analogs, cyclophosphamide methylprednisone, prednisone, azathioprine, FK-506, 15-deoxyspergualin, and other immunosuppressive agents that act by suppressing the function of responding T cells. Other immunosuppressive agents that may be administered in combination with the Therapeutics of the invention include, but are not limited to, prednisolone, methotrexate, thalidomide, methoxsalen, rapamycin, leflunomide, mizoribine (BREDININT™), brequinar, deoxyspergualin, and azaspirane (SKF 105685), ORTHOCLONE OKT® 3 (muromonab-CD3), SANDIMMUNE™, NEORAL™, SANGDYA™ (cyclosporine), PROGRAF® (FK506, tacrolimus), CELLCEPT® (mycophenolate motefil, of which the active metabolite is mycophenolic acid), IMURAN™ (azathioprine), glucocorticosteroids, adrenocortical steroids such as DELTASONE™ (prednisone) and HYDELTRASOL™ (prednisolone), FOLEX™ and MEXATE™ (methotrxate), OXSORALEN-ULTRAT™ (methoxsalen) and RAPAIVHINE™ (sirolimus). In a specific embodiment, immunosuppressants may be used to prevent rejection of organ or bone marrow transplantation.

In an additional embodiment, Therapeutics of the invention are administered alone or in combination with one or more intravenous immune globulin preparations. Intravenous immune globulin preparations that may be administered with the Therapeutics of the invention include, but not limited to, GAMMAR™, IVEEGAMT™, SANDOGLOBULIN™, GAMMAGARD S/D™, ATGAM™ (antithymocyte glubulin), and GAMIMUNE™. In a specific embodiment, Therapeutics of the invention are administered in combination with intravenous immune globulin preparations in transplantation therapy (e.g., bone marrow transplant).

In certain embodiments, the Therapeutics of the invention are administered alone or in combination with an anti-inflammatory agent. Anti-inflammatory agents that may be administered with the Therapeutics of the invention include, but are not limited to, corticosteroids (e.g. betamethasone, budesonide, cortisone, dexamethasone, hydrocortisone, methylprednisolone, prednisolone, prednisone, and triamcinolone), nonsteroidal anti-inflammatory drugs (e.g., diclofenac, diflunisal, etodolac, fenoprofen, floctafenine, flurbiprofen, ibuprofen, indomethacin, ketoprofen, meclofenamate, mefenamic acid, meloxicam, nabumetone, naproxen, oxaprozin, phenylbutazone, piroxicam, sulindac, tenoxicam, tiaprofenic acid, and tolmetin.), as well as antihistamines, aminoarylcarboxylic acid derivatives, arylacetic acid derivatives, arylbutyric acid derivatives, arylcarboxylic acids, arylpropionic acid derivatives, pyrazoles, pyrazolones, salicylic acid derivatives, thiazinecarboxamides, e-acetamidocaproic acid, 5-adenosylmethionine, 3-amino-4-hydroxybutyric acid, amixetrine, bendazac, benzydamine, bucolome, difenpiramide, ditazol, emorfazone, guaiazulene, nabumetone, nimesulide, orgotein, oxaceprol, paranyline, perisoxal, pifoxime, proquazone, proxazole, and tenidap.

In an additional embodiment, the compositions of the invention are administered alone or in combination with an anti-angiogenic agent. Anti-angiogenic agents that may be administered with the compositions of the invention include, but are not limited to, Angiostatin (Entremed, Rockville, Md.), Troponin-1 (Boston Life Sciences, Boston, Mass.), anti-Invasive Factor, retinoic acid and derivatives thereof, paclitaxel (Taxol), Suramin, Tissue Inhibitor of Metalloproteinase-1, Tissue Inhibitor of Metalloproteinase-2, VEGI, Plasminogen Activator Inhibitor-1, Plasminogen Activator Inhibitor-2, and various forms of the lighter "d group" transition metals.

Lighter "d group" transition metals include, for example, vanadium, molybdenum, tungsten, titanium, niobium, and tantalum species. Such transition metal species may form transition metal complexes. Suitable complexes of the above-mentioned transition metal species include oxo transition metal complexes.

Representative examples of vanadium complexes include oxo vanadium complexes such as vanadate and vanadyl complexes. Suitable vanadate complexes include metavanadate and orthovanadate complexes such as, for example, ammonium metavanadate, sodium metavanadate, and sodium orthovanadate. Suitable vanadyl complexes include, for example, vanadyl acetylacetonate and vanadyl sulfate including vanadyl sulfate hydrates such as vanadyl sulfate mono- and trihydrates.

Representative examples of tungsten and molybdenum complexes also include oxo complexes. Suitable oxo tungsten complexes include tungstate and tungsten oxide complexes. Suitable tungstate complexes include ammonium tungstate, calcium tungstate, sodium tungstate dihydrate, and tungstic acid. Suitable tungsten oxides include tungsten (IV) oxide and tungsten (VI) oxide. Suitable oxo molybdenum complexes include molybdate, molybdenum oxide, and molybdenyl complexes. Suitable molybdate complexes include ammonium molybdate and its hydrates, sodium molybdate and its hydrates, and potassium molybdate and its hydrates. Suitable molybdenum oxides include molybdenum (VI) oxide, molybdenum (VI) oxide, and molybdic acid. Suitable molybdenyl complexes include, for example, molybdenyl acetylacetonate. Other suitable tungsten and molybdenum complexes include hydroxo derivatives derived from, for example, glycerol, tartaric acid, and sugars.

A wide variety of other anti-angiogenic factors may also be utilized within the context of the present invention. Representative examples include, but are not limited to, platelet factor 4; protamine sulphate; sulphated chitin derivatives (prepared from queen crab shells), (Murata et al., Cancer Res. 51:22-26, (1991)); Sulphated Polysaccharide Peptidoglycan Complex (SP-PG) (the function of this compound may be enhanced by the presence of steroids such as estrogen, and tamoxifen citrate); Staurosporine; modulators of matrix metabolism, including for example, proline analogs, cishydroxyproline, d,L-3,4-dehydroproline, Thiaproline, alpha,alpha-dipyridyl, aminopropionitrile fumarate; 4-propyl-5-(4-pyridinyl)-2(3H)-oxazolone; Methotrexate; Mitoxantrone; Heparin; Interferons; 2 Macroglobulin-serum; ChIMP-3 (Pavloff et al., J. Bio. Chem. 267:17321-17326, (1992)); Chymostatin (Tomkinson et al., Biochem J. 286:475-480, (1992)); Cyclodextrin Tetradecasulfate; Eponemycin; Camptothecin;

Fumagillin (Ingber et al., Nature 348:555-557, (1990)); Gold Sodium Thiomalate ("GST"; Matsubara and Ziff, J. Clin. Invest. 79:1440-1446, (1987)); anticollagenase-serum; alpha2-antiplasmin (Holmes et al., J. Biol. Chem. 262(4): 1659-1664, (1987)); Bisantrene (National Cancer Institute); Lobenzarit disodium (N-(2)-carboxyphenyl-4-chloroanthronilic acid disodium or "CCA"; (Takeuchi et al., Agents Actions 36:312-316, (1992)); and metalloproteinase inhibitors such as BB94.

Additional anti-angiogenic factors that may also be utilized within the context of the present invention include Thalidomide, (Celgene, Warren, N.J.); Angiostatic steroid; AGM-1470 (H. Brem and J. Folkman J Pediatr. Surg. 28:445-51 (1993)); an integrin alpha v beta 3 antagonist (C. Storgard et al., J Clin. Invest. 103:47-54 (1999)); carboxynaminolmidazole; Carboxyamidotriazole (CAI) (National Cancer Institute, Bethesda, Md.); Conbretastatin A-4 (CA4P) (OXiGENE, Boston, Mass.); Squalamine (Magainin Pharmaceuticals, Plymouth Meeting, Pa.); TNP-470, (Tap Pharmaceuticals, Deerfield, Ill.); ZD-0101 AstraZeneca (London, UK); APRA (CT2584); Benefin, Byrostatin-1 (SC339555); CGP-41251 (PKC 412); CM101; Dexrazoxane (ICRF187); DMXAA; Endostatin; Flavopridiol; Genestein; GTE; ImmTher; Iressa (ZD1839); Octreotide (Somatostatin); Panretin; Penacillamine; Photopoint; PI-88; Prinomastat (AG-3340) Purlytin; Suradista (FCE26644); Tamoxifen (Nolvadex); Tazarotene; Tetrathiomolybdate; Xeloda (Capecitabine); and 5-Fluorouracil.

Anti-angiogenic agents that may be administed in combination with the compounds of the invention may work through a variety of mechanisms including, but not limited to, inhibiting proteolysis of the extracellular matrix, blocking the function of endothelial cell-extracellular matrix adhesion molecules, by antagonizing the function of angiogenesis inducers such as growth factors, and inhibiting integrin receptors expressed on proliferating endothelial cells. Examples of anti-angiogenic inhibitors that interfere with extracellular matrix proteolysis and which may be administered in combination with the compositons of the invention include, but are not lmited to, AG-3340 (Agouron, La Jolla, Calif.), BAY-12-9566 (Bayer, West Haven, Conn.), BMS-275291 (Bristol Myers Squibb, Princeton, N.J.), CGS-27032A (Novartis, East Hanover, N.J.), Marimastat (British Biotech, Oxford, UK), and Metastat (Aeterna, St-Foy, Quebec). Examples of anti-angiogenic inhibitors that act by blocking the function of endothelial cell-extracellular matrix adhesion molecules and which may be administered in combination with the compositons of the invention include, but are not lmited to, EMD-121974 (Merck KcgaA Darmstadt, Germany) and Vitaxin (Ixsys, La Jolla, Calif./Medimmune, Gaithersburg, Md.). Examples of anti-angiogenic agents that act by directly antagonizing or inhibiting angiogenesis inducers and which may be administered in combination with the compositons of the invention include, but are not lmited to, Angiozyme (Ribozyme, Boulder, Colo.), Anti-VEGF antibody (Genentech, S. San Francisco, Calif.), PTK-787/ZK-225846 (Novartis, Basel, Switzerland), SU-101 (Sugen, S. San Francisco, Calif.), SU-5416 (Sugen/Pharmacia Upjohn, Bridgewater, N.J.), and SU-6668 (Sugen). Other anti-angiogenic agents act to indirectly inhibit angiogenesis. Examples of indirect inhibitors of angiogenesis which may be administered in combination with the compositons of the invention include, but are not limited to, IM-862 (Cytran, Kirkland, Wash.), Interferon-alpha, IL-12 (Roche, Nutley, N.J.), and Pentosan polysulfate (Georgetown University, Washington, D.C.).

In particular embodiments, the use of compositions of the invention in combination with anti-angiogenic agents is contemplated for the treatment, prevention, and/or amelioration of an autoimmune disease, such as for example, an autoimmune disease described herein.

In a particular embodiment, the use of compositions of the invention in combination with anti-angiogenic agents is contemplated for the treatment, prevention, and/or amelioration of arthritis. In a more particular embodiment, the use of compositions of the invention in combination with anti-angiogenic agents is contemplated for the treatment, prevention, and/or amelioration of rheumatoid arthritis.

In another embodiment, the polynucleotides encoding a polypeptide of the present invention are administered in combination with an angiogenic protein, or polynucleotides encoding an angiogenic protein. Examples of angiogenic proteins that may be administered with the compositions of the invention include, but are not limited to, acidic and basic fibroblast growth factors, VEGF-1, VEGF-2, VEGF-3, epidermal growth factor alpha and beta, platelet-derived endothelial cell growth factor, platelet-derived growth factor, tumor necrosis factor alpha, hepatocyte growth factor, insulin-like growth factor, colony stimulating factor, macrophage colony stimulating factor, granulocyte/macrophage colony stimulating factor, and nitric oxide synthase.

In additional embodiments, compositions of the invention are administered in combination with a chemotherapeutic agent. Chemotherapeutic agents that may be administered with the Therapeutics of the invention include, but are not limited to alkylating agents such as nitrogen mustards (for example, Mechlorethamine, cyclophosphamide, Cyclophosphamide Ifosfamide, Melphalan (L-sarcolysin), and Chlorambucil), ethylenimines and methylmelamines (for example, Hexamethylmelamine and Thiotepa), alkyl sulfonates (for example, Busulfan), nitrosoureas (for example, Carmustine (BCNU), Lomustine (CCNU), Semustine (methyl-CCNU), and Streptozocin (streptozotocin)), triazenes (for example, Dacarbazine (DTIC; dimethyltriazenoimidazolecarboxamide)), folic acid analogs (for example, Methotrexate (amethopterin)), pyrimidine analogs (for example, Fluorouacil (5-fluorouracil; 5-FU), Floxuridine (fluorodeoxyuridine; FudR), and Cytarabine (cytosine arabinoside)), purine analogs and related inhibitors (for example, Mercaptopurine (6-mercaptopurine; 6-MP), Thioguanine (6-thioguanine; TG), and Pentostatin (2'-deoxycoformycin)), vinca alkaloids (for example, Vinblastine (VLB, vinblastine sulfate)) and Vincristine (vincristine sulfate)), epipodophyllotoxins (for example, Etoposide and Teniposide), antibiotics (for example, Dactinomycin (actinomycin D), Daunorubicin (daunomycin; rubidomycin), Doxorubicin, Bleomycin, Plicamycin (mithramycin), and Mitomycin (mitomycin C), enzymes (for example, L-Asparaginase), biological response modifiers (for example, Interferon-alpha and interferon-alpha-2b), platinum coordination compounds (for example, Cisplatin (cis-DDP) and Carboplatin), anthracenedione (Mitoxantrone), substituted ureas (for example, Hydroxyurea), methylhydrazine derivatives (for example, Procarbazine (N-methylhydrazine; MIH), adrenocorticosteroids (for example, Prednisone), progestins (for example, Hydroxyprogesterone caproate, Medroxyprogesterone, Medroxyprogesterone acetate, and Megestrol acetate), estrogens (for example, Diethylstilbestrol (DES), Diethylstilbestrol diphosphate, Estradiol, and Ethinyl estradiol), antiestrogens (for example, Tamoxifen), androgens (Testosterone proprionate, and Fluoxymesterone), antiandrogens (for example, Flutamide), gonadotropin-releasing horomone analogs (for example, Leuprolide), other hormones and hormone analogs (for example, methyltestosterone, estramustine, estramustine phosphate sodium, chlorotrianisene, and testolactone), and others (for example, dicarbazine, glutamic acid, and mitotane).

In one embodiment, the compositions of the invention are administered in combination with one or more of the following drugs: infliximab (also known as Remicade™ Centocor, Inc.), Trocade (Roche, RO-32-3555), Leflunomide (also known as Arava™ from Hoechst Marion Roussel), Kineret™ (an IL-1 Receptor antagonist also known as Anakinra from Amgen, Inc.)

In a specific embodiment, compositions of the invention are administered in combination with CHOP (cyclophosphamide, doxorubicin, vincristine, and prednisone) or combination of one or more of the components of CHOP. In one embodiment, the compositions of the invention are administered in combination with anti-CD20 antibodies, human monoclonal anti-CD20 antibodies. In another embodiment, the compositions of the invention are administered in combination with anti-CD20 antibodies and CHOP, or anti-CD20 antibodies and any combination of one or more of the components of CHOP, particularly cyclophosphamide and/or prednisone. In a specific embodiment, compositions of the invention are administered in combination with Rituximab. In a further embodiment, compositions of the invention are administered with Rituximab and CHOP, or Rituximab and any combination of one or more of the components of CHOP, particularly cyclophosphamide and/or prednisone. In a specific embodiment, compositions of the invention are administered in combination with tositumomab. In a further embodiment, compositions of the invention are administered with tositumomab and CHOP, or tositumomab and any combination of one or more of the components of CHOP, particularly cyclophosphamide and/or prednisone. The anti-CD20 antibodies may optionally be associated with radioisotopes, toxins or cytotoxic prodrugs.

In another specific embodiment, the compositions of the invention are administered in combination Zevalin™. In a further embodiment, compositions of the invention are administered with Zevalin™ and CHOP, or Zevalin™ and any combination of one or more of the components of CHOP, particularly cyclophosphamide and/or prednisone. Zevalin™ may be associated with one or more radisotopes. Particularly preferred isotopes are $^{90}$Y and $^{111}$In.

In an additional embodiment, the Therapeutics of the invention are administered in combination with cytokines. Cytokines that may be administered with the Therapeutics of the invention include, but are not limited to, IL2, IL3, IL4, IL5, IL6, IL7, IL10, IL12, IL13, IL15, anti-CD40, CD40L, IFN-gamma and TNF-alpha. In another embodiment, Therapeutics of the invention may be administered with any interleukin, including, but not limited to, IL-1alpha, IL-1beta, IL-2, IL-3, IL-4, IL-5, IL-6, IL-7, IL-8, IL-9, IL-10, IL-11, IL-12, IL-13, IL-14, IL-15, IL-16, IL-17, IL-18, IL-19, IL-20, and IL-21.

In one embodiment, the Therapeutics of the invention are administered in combination with members of the TNF family. TNF, TNF-related or TNF-like molecules that may be administered with the Therapeutics of the invention include, but are not limited to, soluble forms of TNF-alpha, lymphotoxin-alpha (LT-alpha, also known as TNF-beta), LT-beta (found in complex heterotrimer LT-alpha2-beta), OPGL, FasL, CD27L, CD30L, CD40L, 4-1BBL, DcR3, OX40L, TNF-gamma (International Publication No. WO 96/14328), AIM-I (International Publication No. WO 97/33899), endokine-alpha (International Publication No. WO 98/07880), OPG, and neutrokine-alpha (International Publication No. WO 98/18921, OX40, and nerve growth factor (NGF), and soluble forms of Fas, CD30, CD27, CD40 and 4-IBB, TR2 (International Publication No. WO 96/34095), DR3 (International Publication No. WO 97/33904), DR4 (International Publication No. WO 98/32856), TR5 (International Publication No. WO 98/30693), TRANK, TR9 (International Publication No. WO 98/56892), TR10 (International Publication No. WO 98/54202), 312C2 (International Publication No. WO 98/06842), and TR12, and soluble forms CD154, CD70, and CD153.

In an additional embodiment, the Therapeutics of the invention are administered in combination with angiogenic proteins. Angiogenic proteins that may be administered with the Therapeutics of the invention include, but are not limited to, Glioma Derived Growth Factor (GDGF), as disclosed in European Patent Number EP-399816; Platelet Derived Growth Factor-A (PDGF-A), as disclosed in European Patent Number EP-682110; Platelet Derived Growth Factor-B (PDGF-B), as disclosed in European Patent Number EP-282317; Placental Growth Factor (P1GF), as disclosed in International Publication Number WO 92/06194; Placental Growth Factor-2 (P1GF-2), as disclosed in Hauser et al., Growth Factors, 4:259-268 (1993); Vascular Endothelial Growth Factor (VEGF), as disclosed in International Publication Number WO 90/13649; Vascular Endothelial Growth Factor-A (VEGF-A), as disclosed in European Patent Number EP-506477; Vascular Endothelial Growth Factor-2 (VEGF-2), as disclosed in International Publication Number WO 96/39515; Vascular Endothelial Growth Factor B (VEGF-3); Vascular Endothelial Growth Factor B-186 (VEGF-B186), as disclosed in International Publication Number WO 96/26736; Vascular Endothelial Growth Factor-D (VEGF-D), as disclosed in International Publication Number WO 98/02543; Vascular Endothelial Growth Factor-D (VEGF-D), as disclosed in International Publication Number WO 98/07832; and Vascular Endothelial Growth Factor-E (VEGF-E), as disclosed in German Patent Number DE19639601. The above mentioned references are herein incorporated by reference in their entireties.

In an additional embodiment, the Therapeutics of the invention are administered in combination with Fibroblast Growth Factors. Fibroblast Growth Factors that may be administered with the Therapeutics of the invention include, but are not limited to, FGF-1, FGF-2, FGF-3, FGF-4, FGF-5, FGF-6, FGF-7, FGF-8, FGF-9, FGF-10, FGF-11, FGF-12, FGF-13, FGF-14, and FGF-15.

In an additional embodiment, the Therapeutics of the invention are administered in combination with hematopoietic growth factors. Hematopoietic growth factors that may be administered with the Therapeutics of the invention include, but are not limited to, granulocyte macrophage colony stimulating factor (GM-CSF) (sargramostim, LEUKINE™, PROKINE™), granulocyte colony stimulating factor (G-CSF) (filgrastim, NEUPOGEN™), macrophage colony stimulating factor (M-CSF, CSF-1) erythropoietin (epoetin alfa, EPOGEN™ PROCRIT™), stem cell factor (SCF, c-kit ligand, steel factor), megakaryocyte colony stimulating factor, PIXY321 (a GMCSF/IL-3 fusion protein), interleukins, especially any one or more of IL-1 through IL-12, interferon-gamma, or thrombopoietin.

In certain embodiments, Therapeutics of the present invention are administered in combination with adrenergic blockers, such as, for example, acebutolol, atenolol, betaxolol, bisoprolol, carteolol, labetalol, metoprolol, nadolol, oxprenolol, penbutolol, pindolol, propranolol, sotalol, and timolol.

In another embodiment, the Therapeutics of the invention are administered in combination with an antiarrhythmic drug (e.g., adenosine, amidoarone, bretylium, digitalis, digoxin, digitoxin, diliazem, disopyramide, esmolol, flecamide, lidocaine, mexiletine, moricizine, phenyloin, procainamide, N-acetyl procainamide, propafenone, propranolol, quinidine, sotalol, tocamide, and verapamil).

In another embodiment, the Therapeutics of the invention are administered in combination with diuretic agents, such as carbonic anhydrase-inhibiting agents (e.g., acetazolamide, dichlorphenamide, and methazolamide), osmotic diuretics (e.g., glycerin, isosorbide, mannitol, and urea), diuretics that inhibit $Na^+$-$K^+$-$2Cl^-$ symport (e.g., furosemide, bumetanide, azosemide, piretanide, tripamide, ethacrynic acid, muzolimine, and torsemide), thiazide and thiazide-like diuretics (e.g., bendroflumethiazide, benzthiazide, chlorothiazide, hydrochlorothiazide, hydroflumethiazide, methyclothiazide, polythiazide, trichormethiazide, chlorthalidone, indapamide, metolazone, and quinethazone), potassium sparing diuretics (e.g., amiloride and triamterene), and mineralcorticoid receptor antagonists (e.g., spironolactone, canrenone, and potassium canrenoate).

In one embodiment, the Therapeutics of the invention are administered in combination with treatments for endocrine and/or hormone imbalance disorders. Treatments for endocrine and/or hormone imbalance disorders include, but are not limited to, $^{127}I$, radioactive isotopes of iodine such as $^{131}I$ and $^{123}I$; recombinant growth hormone, such as HUMATROPE™ (recombinant somatropin); growth hormone analogs such as PROTROPIN™ (somatrem); dopamine agonists such as PARLODEL™ (bromocriptine); somatostatin analogs such as SANDOSTATINT™ (octreotide); gonadotropin preparations such as PREGNYL™, A.P.L.™ and PROFASI™ (chorionic gonadotropin (CG)), PERGONAL™ (menotropins), and METRODINT™ (urofollitropin (uFSH)); synthetic human gonadotropin releasing hormone preparations such as FACTREL™ and LUTREPULSE™ (gonadorelin hydrochloride); synthetic gonadotropin agonists such as LUPRON™ (leuprolide acetate), SUPPRELIN™ (histrelin acetate), SYNAREL™ (nafarelin acetate), and ZOLADEX™ (goserelin acetate); synthetic preparations of thyrotropin-releasing hormone such as RELEFACT TRH™ and THYPINONET™ (protirelin); recombinant human TSH such as THYROGEN™; synthetic preparations of the sodium salts of the natural isomers of thyroid hormones such as L-$T_4$™, SYNTHROID™ and LEVOTHROID™ (levothyroxine sodium), L-$T_3$™, CYTOMEL™ and TRIOSTATT™ (liothyroine sodium), and THYROLAR™ (liotrix); antithyroid compounds such as 6-n-propylthiouracil (propylthiouracil), 1-methyl-2-mercaptoimidazole and TAPAZOLE™ (methimazole), NEO-MERCAZOLE™ (carbimazole); beta-adrenergic receptor antagonists such as propranolol and esmolol; $Ca^{2+}$ channel blockers; dexamethasone and iodinated radiological contrast agents such as TELEPAQUE™ (iopanoic acid) and ORAGRAFIN™ (sodium ipodate).

Additional treatments for endocrine and/or hormone imbalance disorders include, but are not limited to, estrogens or congugated estrogens such as ESTRACE™ (estradiol), ESTINYLT™ (ethinyl estradiol), PREMARINT™, ESTRATAB™, ORTHO-EST™, OGEN™ and estropipate (estrone), ESTROVIS™ (quinestrol), ESTRADERM™ (estradiol), DELESTROGEN™ and VALERGEN™ (estradiol valerate), DEPO-ESTRADIOL CYPIONATE™ and ESTROJECT LA™ (estradiol cypionate); antiestrogens such as NOLVADEX™ (tamoxifen), SEROPHENE™ and CLOMID™ (clomiphene); progestins such as DURALUTINT™ (hydroxyprogesterone caproate), MPA™ and DEPO-PROVERA™ (medroxyprogesterone acetate), PROVERA™ and CYCRIN™ (MPA), MEGACE™ (megestrol acetate), NORLUTINT™ (norethindrone), and NORLUTATE™ and AYGESTINT™ (norethindrone acetate); progesterone implants such as NORPLANT SYSTEM™ (subdermal implants of norgestrel); antiprogestins such as RU 486™ (mifepristone); hormonal contraceptives such as ENOVID™ (norethynodrel plus mestranol), PROGESTASERT™ (intrauterine device that releases progesterone), LOESTRINT™, BREVICON™, MODICON™ GENORA™, NELONA™, NORINYL™, OVACON-35™ and OVACON-50™ (ethinyl estradiol/norethindrone), LEVLEN™, NORDETTE™, TRI-LEVLEN™ and TRIPHASIL-21™ (ethinyl estradiol/levonorgestrel) LO/OVRAL™ and OVRAL™ (ethinyl estradiol/norgestrel), DEMULEN™ (ethinyl estradiol/ethynodiol diacetate), NORINYL™, ORTHO-NOVUMT™, NORETHINT™, GENORA™, and NELOVA™ (norethindrone/mestranol), DESOGEN™ and ORTHO-CEPT™ (ethinyl estradiol/desogestrel), ORTHO-CYCLEN™ and ORTHO-TRICYCLEN™ (ethinyl estradiol/norgestimate), MICRONOR™ and NOR-QD™ (norethindrone), and OVRETTE™ (norgestrel).

Additional treatments for endocrine and/or hormone imbalance disorders include, but are not limited to, testosterone esters such as methenolone acetate and testosterone undecanoate; parenteral and oral androgens such as TEST-OJECT-50™ (testosterone), TESTEX™ (testosterone propionate), DELATESTRYL™ (testosterone enanthate), DEPO-TESTOSTERONE™ (testosterone cypionate), DANOCRINE™ (danazol), HALOTESTINT™ (fluoxymesterone), ORETON METHYL™, TESTRED™ and VIRILON™ (methyltestosterone), and OXANDRIN™ (oxandrolone); testosterone transdermal systems such as TESTODERM™; androgen receptor antagonist and 5-alpha-reductase inhibitors such as ANDROCUR™ (cyproterone acetate), EULEXIN™ (flutamide), and PROSCAR™ (finasteride); adrenocorticotropic hormone preparations such as CORTROSYN™ (cosyntropin); adrenocortical steroids and their synthetic analogs such as ACLOVATE™ (alclometasone dipropionate), CYCLOCORT™ (amcinonide), BECLOVENT™ and VANCERIL™ (beclomethasone dipropionate), CELESTONE™ (betamethasone), BENISONE™ and UTICORT™ (betamethasone benzoate), DIPROSONE™ (betamethasone dipropionate), CELESTONE PHOSPHATE™ (betamethasone sodium phosphate), CELESTONE SOLUSPAN™ (betamethasone sodium phosphate and acetate), BETA-VALT™ and VALISONE™ (betamethasone valerate), TEMOVATE™ (clobetasol propionate), CLODERM™ (clocortolone pivalate), CORTEF™ and HYDROCORTONE™ (cortisol (hydrocortisone)), HYDROCORTONE ACETATE™ (cortisol (hydrocortisone) acetate), LOCOID™ (cortisol (hydrocortisone) butyrate), HYDROCORTONE PHOSPHATE™ (cortisol (hydrocortisone) sodium phosphate), A-HYDROCORT™ and SOLU CORTEF™ (cortisol (hydrocortisone) sodium succinate), WESTCORT™ (cortisol (hydrocortisone) valerate), CORTISONE ACETATE™ (cortisone acetate), DESOWEN™ and TRIDESILON™ (desonide), TOPICORT™ (desoximetasone), DECADRON™ (dexamethasone), DECADRON LA™ (dexamethasone acetate), DECADRON PHOSPHATE™ and HEXADROL PHOSPHATE™ (dexamethasone sodium phosphate), FLORONE™ and MAXIFLOR™ (diflorasone diacetate), FLORINEF ACETATE™ (fludrocortisone acetate), AEROBID™ and NASALIDE™ (flunisolide), FLUONID™ and SYNALAR™ (fluocinolone acetonide), LIDEX™ (fluocinonide), FLUOR-OP™ and FML™ (fluorometholone), CORDRAN™ (flurandrenolide), HALOG™ (halcinonide), HMS LIZUIFILM™ (medrysone), MEDROL™ (methylprednisolone), DEPO-MEDROL™ and MEDROL ACETATE™ (methylprednisone acetate), A-METHAPRED™ and SOLUMEDROL™ (methylprednisolone sodium succinate), ELOCON™ (mometasone furoate), HALDRONE™ (paramethasone acetate), DELTA-CORTEF™ (prednisolone), ECONOPRED™ (prednisolone acetate), HYDELTRASOL™ (prednisolone sodium phosphate), HYDELTRA-T.B.A™ (prednisolone tebutate), DELTASONE™ (prednisone), ARISTOCORT™ and KENACORT™ (triamcinolone), KENALOG™ (triamcinolone acetonide), ARISTOCORT™ and KENACORT DIACETATE™ (triamcinolone diacetate), and ARISTOSPAN™ (triamcinolone hexacetonide); inhibitors of biosynthesis and action of adrenocortical steroids such as CYTADREN™ (aminoglutethimide), NIZORAL™ (ketoconazole), MODRASTANE™ (trilostane), and METOPIRONE™ (metyrapone).

Additional treatments for endocrine and/or hormone imbalance disorders include, but are not limited to bovine, porcine or human insulin or mixtures thereof; insulin analogs; recombinant human insulin such as HUMULINT™ and NOVOLIN™; oral hypoglycemic agents such as ORAMIDE™ and ORINASE™ (tolbutamide), DIABINESE™ (chlorpropamide), TOLAMIDE™ and TOLINASET™ (tolazamide), DYMELOR™ (acetohexamide), glibenclamide, MICRONASE™, DIBETA™ and GLYNASE™ (glyburide), GLUCOTROL™ (glipizide), and DIAMICRON™ (gliclazide), GLUCOPHAGE™ (metformin), PRECOSE™ (acarbose), AMARYL™ (glimepiride), and ciglitazone; thiazolidinediones (TZDs) such as rosiglitazone, AVANDIA™ (rosiglitazone maleate) ACTOS™ (piogliatazone), and troglitazone; alpha-glucosidase inhibitors; bovine or porcine glucagon; somatostatins such as SANDOSTATINT™ (octreotide); and diazoxides such as PROGLYCEM™ (diazoxide). In still other embodiments, Therapeutics of the invention are administered in combination with one or more of the following: a biguanide antidiabetic agent, a glitazone antidiabetic agent, and a sulfonylurea antidiabetic agent.

In one embodiment, the Therapeutics of the invention are administered in combination with treatments for uterine motility disorders. Treatments for uterine motility disorders include, but are not limited to, estrogen drugs such as conjugated estrogens (e.g., PREMARIN® and ESTRATAB®), estradiols (e.g., CLIMARA® and ALORA®), estropipate, and chlorotrianisene; progestin drugs (e.g., AMEN® (medroxyprogesterone), MICRONOR® (norethidrone acetate), PROMETRIUM® progesterone, and megestrol acetate); and estrogen/progesterone combination therapies such as, for example, conjugated estrogens/medroxyprogesterone (e.g., PREMPRO™ and PREMPHASE®) and norethindrone acetate/ethinyl estsradiol (e.g., FEMHRTT™).

In an additional embodiment, the Therapeutics of the invention are administered in combination with drugs effective in treating iron deficiency and hypochromic anemias, including but not limited to, ferrous sulfate (iron sulfate, FEOSOL™), ferrous fumarate (e.g., FEOSTAT™), ferrous gluconate (e.g., FERGON™), polysaccharide-iron complex (e.g., NIFEREX™), iron dextran injection (e.g., INFED™), cupric sulfate, pyroxidine, riboflavin, Vitamin $B_{12}$, cyancobalamin injection (e.g., REDISOL™, RUBRAMIN PC™), hydroxocobalamin, folic acid (e.g., FOLVITE™), leucovorin (folinic acid, 5-CHOH4PteGlu, citrovorum factor) or WELLCOVORIN (Calcium salt of leucovorin), transferrin or ferritin.

In certain embodiments, the Therapeutics of the invention are administered in combination with agents used to treat psychiatric disorders. Psychiatric drugs that may be administered with the Therapeutics of the invention include, but are not limited to, antipsychotic agents (e.g., chlorpromazine, chlorprothixene, clozapine, fluphenazine, haloperidol, loxapine, mesoridazine, molindone, olanzapine, perphenazine, pimozide, quetiapine, risperidone, thioridazine, thiothixene, trifluoperazine, and triflupromazine), antimanic agents (e.g., carbamazepine, divalproex sodium, lithium carbonate, and lithium citrate), antidepressants (e.g., amitriptyline, amoxapine, bupropion, citalopram, clomipramine, desipramine, doxepin, fluvoxamine, fluoxetine, imipramine, isocarboxazid, maprotiline, mirtazapine, nefazodone, nortriptyline, paroxetine, phenelzine, protriptyline, sertraline, tranylcypromine, trazodone, trimipramine, and venlafaxine), antianxiety agents (e.g., alprazolam, buspirone, chlordiazepoxide, clorazepate, diazepam, halazepam, lorazepam, oxazepam, and prazepam), and stimulants (e.g., d-amphetamine, methylphenidate, and pemoline).

In other embodiments, the Therapeutics of the invention are administered in combination with agents used to treat neurological disorders. Neurological agents that may be administered with the Therapeutics of the invention include, but are not limited to, antiepileptic agents (e.g., carbamazepine, clonazepam, ethosuximide, phenobarbital, phenyloin, primidone, valproic acid, divalproex sodium, felbamate, gabapentin, lamotrigine, levetiracetam, oxcarbazepine, tiagabine, topiramate, zonisamide, diazepam, lorazepam, and clonazepam), antiparkinsonian agents (e.g., levodopa/carbidopa, selegiline, amantidine, bromocriptine, pergolide, ropinirole, pramipexole, benztropine; biperiden; ethopropazine; procyclidine; trihexyphenidyl, tolcapone), and ALS therapeutics (e.g. riluzole).

In another embodiment, Therapeutics of the invention are administered in combination with vasodilating agents and/or calcium channel blocking agents. Vasodilating agents that may be administered with the Therapeutics of the invention include, but are not limited to, Angiotensin Converting Enzyme (ACE) inhibitors (e.g., papaverine, isoxsuprine, benazepril, captopril, cilazapril, enalapril, enalaprilat, fosinopril, lisinopril, moexipril, perindopril, quinapril, ramipril, spirapril, trandolapril, and nylidrin), and nitrates (e.g., isosorbide dinitrate, isosorbide mononitrate, and nitroglycerin). Examples of calcium channel blocking agents that may be administered in combination with the Therapeutics of the invention include, but are not limited to amlodipine, bepridil, diltiazem, felodipine, flunarizine, isradipine, nicardipine, nifedipine, nimodipine, and verapamil.

In additional embodiments, the Therapeutics of the invention are administered in combination with other therapeutic or prophylactic regimens, such as, for example, radiation therapy.

Example 24

Method of Treating Decreased Levels of the Polypeptide

The present invention relates to a method for treating an individual in need of an increased level of a polypeptide of the invention in the body comprising administering to such an individual a composition comprising a therapeutically effective amount of an agonist of the invention (including polypeptides of the invention). Moreover, it will be appreciated that conditions caused by a decrease in the standard or normal expression level of a secreted protein in an individual can be treated by administering the polypeptide of the present invention, preferably in the secreted form. Thus, the invention also provides a method of treatment of an individual in need of an increased level of the polypeptide comprising administering to such an individual a Therapeutic comprising an amount of the polypeptide to increase the activity level of the polypeptide in such an individual.

For example, a patient with decreased levels of a polypeptide receives a daily dose 0.1-100 ug/kg of the polypeptide for six consecutive days. Preferably, the polypeptide is in the secreted form. The exact details of the dosing scheme, based on administration and formulation, are provided in Example 23.

Example 25

Method of Treating Increased Levels of the Polypeptide

The present invention also relates to a method of treating an individual in need of a decreased level of a polypeptide of the invention in the body comprising administering to such an individual a composition comprising a therapeutically effective amount of an antagonist of the invention (including polypeptides and antibodies of the invention).

In one example, antisense technology is used to inhibit production of a polypeptide of the present invention. This technology is one example of a method of decreasing levels of a polypeptide, preferably a secreted form, due to a variety of etiologies, such as cancer. For example, a patient diagnosed with abnormally increased levels of a polypeptide is administered intravenously antisense polynucleotides at 0.5, 1.0, 1.5, 2.0 and 3.0 mg/kg day for 21 days. This treatment is repeated after a 7-day rest period if the treatment was well tolerated. The formulation of the antisense polynucleotide is provided in Example 23.

Example 26

Method of Treatment Using Gene Therapy-Ex Vivo

One method of gene therapy transplants fibroblasts, which are capable of expressing a polypeptide, onto a patient. Generally, fibroblasts are obtained from a subject by skin biopsy. The resulting tissue is placed in tissue-culture medium and separated into small pieces. Small chunks of the tissue are placed on a wet surface of a tissue culture flask, approximately ten pieces are placed in each flask. The flask is turned upside down, closed tight and left at room temperature over night. After 24 hours at room temperature, the flask is inverted and the chunks of tissue remain fixed to the bottom of the flask and fresh media (e.g., Ham's F12 media, with 10% FBS, penicillin and streptomycin) is added. The flasks are then incubated at 37 degree C. for approximately one week.

At this time, fresh media is added and subsequently changed every several days. After an additional two weeks in culture, a monolayer of fibroblasts emerge. The monolayer is trypsinized and scaled into larger flasks.

pMV-7 (Kirschmeier, P. T. et al., DNA, 7:219-25 (1988)), flanked by the long terminal repeats of the Moloney murine sarcoma virus, is digested with EcoRI and HindIII and subsequently treated with calf intestinal phosphatase. The linear vector is fractionated on agarose gel and purified, using glass beads.

The cDNA encoding a polypeptide of the present invention can be amplified using PCR primers which correspond to the 5' and 3' end sequences respectively as set forth in Example 1 using primers and having appropriate restriction sites and initiation/stop codons, if necessary. Preferably, the 5' primer contains an EcoRI site and the 3' primer includes a HindIII site. Equal quantities of the Moloney murine sarcoma virus linear backbone and the amplified EcoRI and HindIII fragment are added together, in the presence of T4 DNA ligase. The resulting mixture is maintained under conditions appropriate for ligation of the two fragments. The ligation mixture is then used to transform bacteria HB101, which are then plated onto agar containing kanamycin for the purpose of confirming that the vector has the gene of interest properly inserted.

The amphotropic pA317 or GP+am12 packaging cells are grown in tissue culture to confluent density in Dulbecco's Modified Eagles Medium (DMEM) with 10% calf serum (CS), penicillin and streptomycin. The MSV vector containing the gene is then added to the media and the packaging cells transduced with the vector. The packaging cells now produce infectious viral particles containing the gene (the packaging cells are now referred to as producer cells).

Fresh media is added to the transduced producer cells, and subsequently, the media is harvested from a 10 cm plate of confluent producer cells. The spent media, containing the infectious viral particles, is filtered through a millipore filter to remove detached producer cells and this media is then used to infect fibroblast cells. Media is removed from a sub-confluent plate of fibroblasts and quickly replaced with the media from the producer cells. This media is removed and replaced with fresh media. If the titer of virus is high, then virtually all fibroblasts will be infected and no selection is required. If the titer is very low, then it is necessary to use a retroviral vector that has a selectable marker, such as neo or his. Once the fibroblasts have been efficiently infected, the fibroblasts are analyzed to determine whether protein is produced.

The engineered fibroblasts are then transplanted onto the host, either alone or after having been grown to confluence on cytodex 3 microcarrier beads.

Example 27

Gene Therapy Using Endogenous Genes Corresponding To Polynucleotides of the Invention Another method of gene therapy according to the present invention involves operably associating the endogenous polynucleotide sequence of the invention with a promoter via homologous recombination as described, for example, in U.S. Pat. No. 5,641,670, issued Jun. 24, 1997; International Publication NO: WO 96/29411, published Sep. 26, 1996; International Publication NO: WO 94/12650, published Aug. 4, 1994; Koller et al., *Proc. Natl. Acad. Sci. USA,* 86:8932-8935 (1989); and Zijlstra et al., *Nature,* 342:435-438 (1989). This method involves the activation of a gene which is present in the target cells, but which is not expressed in the cells, or is expressed at a lower level than desired.

Polynucleotide constructs are made which contain a promoter and targeting sequences, which are homologous to the 5' non-coding sequence of endogenous polynucleotide sequence, flanking the promoter. The targeting sequence will be sufficiently near the 5' end of the polynucleotide sequence so the promoter will be operably linked to the endogenous sequence upon homologous recombination. The promoter and the targeting sequences can be amplified using PCR. Preferably, the amplified promoter contains distinct restriction enzyme sites on the 5' and 3' ends. Preferably, the 3' end of the first targeting sequence contains the same restriction enzyme site as the 5' end of the amplified promoter and the 5' end of the second targeting sequence contains the same restriction site as the 3' end of the amplified promoter.

The amplified promoter and the amplified targeting sequences are digested with the appropriate restriction enzymes and subsequently treated with calf intestinal phosphatase. The digested promoter and digested targeting sequences are added together in the presence of T4 DNA ligase. The resulting mixture is maintained under conditions appropriate for ligation of the two fragments. The construct is size fractionated on an agarose gel then purified by phenol extraction and ethanol precipitation.

In this Example, the polynucleotide constructs are administered as naked polynucleotides via electroporation. However, the polynucleotide constructs may also be administered with transfection-facilitating agents, such as liposomes, viral sequences, viral particles, precipitating agents, etc. Such methods of delivery are known in the art.

Once the cells are transfected, homologous recombination will take place which results in the promoter being operably linked to the endogenous polynucleotide sequence. This results in the expression of polynucleotide corresponding to the polynucleotide in the cell. Expression may be detected by immunological staining, or any other method known in the art.

Fibroblasts are obtained from a subject by skin biopsy. The resulting tissue is placed in DMEM+10% fetal calf serum. Exponentially growing or early stationary phase fibroblasts are trypsinized and rinsed from the plastic surface with nutrient medium. An aliquot of the cell suspension is removed for counting, and the remaining cells are subjected to centrifugation. The supernatant is aspirated and the pellet is resuspended in 5 ml of electroporation buffer (20 mM HEPES pH 7.3, 137 mM NaCl, 5 mM KCl, 0.7 mM $Na_2 HPO_4$, 6 mM dextrose). The cells are recentrifuged, the supernatant aspirated, and the cells resuspended in electroporation buffer containing 1 mg/ml acetylated bovine serum albumin. The final cell suspension contains approximately $3 \times 10^6$ cells/ml. Electroporation should be performed immediately following resuspension.

Plasmid DNA is prepared according to standard techniques. For example, to construct a plasmid for targeting to the locus corresponding to the polynucleotide of the invention, plasmid pUC18 (MBI Fermentas, Amherst, N.Y.) is digested with HindIII. The CMV promoter is amplified by PCR with an XbaI site on the 5' end and a BamHI site on the 3' end. Two non-coding sequences are amplified via PCR: one non-coding sequence (fragment 1) is amplified with a HindIII site at the 5' end and an Xba site at the 3' end; the other non-coding sequence (fragment 2) is amplified with a BamHI site at the 5' end and a HindIII site at the 3' end. The CMV promoter and the fragments (1 and 2) are digested with the appropriate enzymes (CMV promoter—XbaI and BamHI; fragment 1-XbaI; fragment 2-BamHI) and ligated together. The resulting ligation product is digested with HindIII, and ligated with the HindIII-digested pUC18 plasmid.

Plasmid DNA is added to a sterile cuvette with a 0.4 cm electrode gap (Bio-Rad). The final DNA concentration is generally at least 120 μg/ml. 0.5 ml of the cell suspension (containing approximately $1.5 \times 10^6$ cells) is then added to the cuvette, and the cell suspension and DNA solutions are gently mixed. Electroporation is performed with a Gene-Pulser apparatus (Bio-Rad). Capacitance and voltage are set at 960 μF and 250-300 V, respectively. As voltage increases, cell survival decreases, but the percentage of surviving cells that stably incorporate the introduced DNA into their genome increases dramatically. Given these parameters, a pulse time of approximately 14-20 mSec should be observed.

Electroporated cells are maintained at room temperature for approximately 5 min, and the contents of the cuvette are then gently removed with a sterile transfer pipette. The cells are added directly to 10 ml of prewarmed nutrient media (DMEM with 15% calf serum) in a 10 cm dish and incubated at 37 degree C. The following day, the media is aspirated and replaced with 10 ml of fresh media and incubated for a further 16-24 hours.

The engineered fibroblasts are then injected into the host, either alone or after having been grown to confluence on cytodex 3 microcarrier beads. The fibroblasts now produce the protein product. The fibroblasts can then be introduced into a patient as described above.

Example 28

Method of Treatment Using Gene Therapy—In Vivo

Another aspect of the present invention is using in vivo gene therapy methods to treat disorders, diseases and conditions. The gene therapy method relates to the introduction of naked nucleic acid (DNA, RNA, and antisense DNA or RNA) sequences into an animal to increase or decrease the expression of the polypeptide. The polynucleotide of the present invention may be operatively linked to a promoter or any other genetic elements necessary for the expression of the polypeptide by the target tissue. Such gene therapy and delivery techniques and methods are known in the art, see, for example, WO90/11092, WO98/11779; U.S. Pat. Nos. 5,693,622, 5,705,151, 5,580,859; Tabata et al., Cardiovasc. Res. 35(3):470-479 (1997); Chao et al., Pharmacol. Res. 35(6): 517-522 (1997); Wolff, Neuromuscul. Disord. 7(5):314-318 (1997); Schwartz et al., Gene Ther. 3(5):405-411 (1996); Tsurumi et al., Circulation 94(12): 3281-3290 (1996) (incorporated herein by reference).

The polynucleotide constructs may be delivered by any method that delivers injectable materials to the cells of an animal, such as, injection into the interstitial space of tissues (heart, muscle, skin, lung, liver, intestine and the like). The polynucleotide constructs can be delivered in a pharmaceutically acceptable liquid or aqueous carrier.

The term "naked" polynucleotide, DNA or RNA, refers to sequences that are free from any delivery vehicle that acts to assist, promote, or facilitate entry into the cell, including viral sequences, viral particles, liposome formulations, lipofectin or precipitating agents and the like. However, the polynucleotides of the present invention may also be delivered in liposome formulations (such as those taught in Felgner P. L. et al. (1995) Ann. NY Acad. Sci. 772:126-139 and Abdallah B. et al. (1995) Biol. Cell 85(1):1-7) which can be prepared by methods well known to those skilled in the art.

The polynucleotide vector constructs used in the gene therapy method are preferably constructs that will not integrate into the host genome nor will they contain sequences that allow for replication. Any strong promoter known to those skilled in the art can be used for driving the expression of DNA. Unlike other gene therapies techniques, one major advantage of introducing naked nucleic acid sequences into target cells is the transitory nature of the polynucleotide synthesis in the cells. Studies have shown that non-replicating DNA sequences can be introduced into cells to provide production of the desired polypeptide for periods of up to six months.

The polynucleotide construct can be delivered to the interstitial space of tissues within the an animal, including of muscle, skin, brain, lung, liver, spleen, bone marrow, thymus, heart, lymph, blood, bone, cartilage, pancreas, kidney, gall bladder, stomach, intestine, testis, ovary, uterus, rectum, nervous system, eye, gland, and connective tissue. Interstitial space of the tissues comprises the intercellular fluid, mucopolysaccharide matrix among the reticular fibers of organ tissues, elastic fibers in the walls of vessels or chambers, collagen fibers of fibrous tissues, or that same matrix within connective tissue ensheathing muscle cells or in the lacunae of bone. It is similarly the space occupied by the plasma of the circulation and the lymph fluid of the lymphatic channels. Delivery to the interstitial space of muscle tissue is preferred for the reasons discussed below. They may be conveniently delivered by injection into the tissues comprising these cells. They are preferably delivered to and expressed in persistent, non-dividing cells which are differentiated, although delivery and expression may be achieved in non-differentiated or less completely differentiated cells, such as, for example, stem cells of blood or skin fibroblasts. In vivo muscle cells are particularly competent in their ability to take up and express polynucleotides.

For the naked polynucleotide injection, an effective dosage amount of DNA or RNA will be in the range of from about 0.05 g/kg body weight to about 50 mg/kg body weight. Preferably the dosage will be from about 0.005 mg/kg to about 20 mg/kg and more preferably from about 0.05 mg/kg to about 5 mg/kg. Of course, as the artisan of ordinary skill will appreciate, this dosage will vary according to the tissue site of injection. The appropriate and effective dosage of nucleic acid sequence can readily be determined by those of ordinary skill in the art and may depend on the condition being treated and the route of administration. The preferred route of administration is by the parenteral route of injection into the interstitial space of tissues. However, other parenteral routes may also be used, such as, inhalation of an aerosol formulation particularly for delivery to lungs or bronchial tissues, throat or mucous membranes of the nose. In addition, naked polynucleotide constructs can be delivered to arteries during angioplasty by the catheter used in the procedure.

The dose response effects of injected polynucleotide in muscle in vivo is determined as follows. Suitable template DNA for production of mRNA coding for polypeptide of the present invention is prepared in accordance with a standard recombinant DNA methodology. The template DNA, which may be either circular or linear, is either used as naked DNA or complexed with liposomes. The quadriceps muscles of mice are then injected with various amounts of the template DNA.

Five to six week old female and male Balb/C mice are anesthetized by intraperitoneal injection with 0.3 ml of 2.5% Avertin. A 1.5 cm incision is made on the anterior thigh, and the quadriceps muscle is directly visualized. The template DNA is injected in 0.1 ml of carrier in a 1 cc syringe through a 27 gauge needle over one minute, approximately 0.5 cm from the distal insertion site of the muscle into the knee and about 0.2 cm deep. A suture is placed over the injection site for future localization, and the skin is closed with stainless steel clips.

After an appropriate incubation time (e.g., 7 days) muscle extracts are prepared by excising the entire quadriceps. Every fifth 15 um cross-section of the individual quadriceps muscles is histochemically stained for protein expression. A time course for protein expression may be done in a similar fashion except that quadriceps from different mice are harvested at different times. Persistence of DNA in muscle following injection may be determined by Southern blot analysis after preparing total cellular DNA and HIRT supernatants from injected and control mice. The results of the above experimentation in mice can be use to extrapolate proper dosages and other treatment parameters in humans and other animals using naked DNA.

Example 29

Transgenic Animals

The polypeptides of the invention can also be expressed in transgenic animals. Animals of any species, including, but not limited to, mice, rats, rabbits, hamsters, guinea pigs, pigs, micro-pigs, goats, sheep, cows and non-human primates, e.g., baboons, monkeys, and chimpanzees may be used to generate transgenic animals. In a specific embodiment, techniques described herein or otherwise known in the art, are used to express polypeptides of the invention in humans, as part of a gene therapy protocol.

Any technique known in the art may be used to introduce the transgene (i.e., polynucleotides of the invention) into animals to produce the founder lines of transgenic animals. Such techniques include, but are not limited to, pronuclear microinjection (Paterson et al., Appl. Microbiol. Biotechnol. 40:691-698 (1994); Carver et al., Biotechnology (NY) 11:1263-1270 (1993); Wright et al., Biotechnology (NY) 9:830-834 (1991); and Hoppe et al., U.S. Pat. No. 4,873,191 (1989)); retrovirus mediated gene transfer into germ lines (Van der Putten et al., Proc. Natl. Acad. Sci., USA 82:6148-6152 (1985)), blastocysts or embryos; gene targeting in embryonic stem cells (Thompson et al., Cell 56:313-321 (1989)); electroporation of cells or embryos (Lo, 1983, Mol. Cell. Biol. 3:1803-1814 (1983)); introduction of the polynucleotides of the invention using a gene gun (see, e.g., Ulmer et al., Science 259:1745 (1993); introducing nucleic acid constructs into embryonic pleuripotent stem cells and transferring the stem cells back into the blastocyst; and sperm-mediated gene transfer (Lavitrano et al., Cell 57:717-723 (1989); etc. For a review of such techniques, see Gordon, "Transgenic Animals," Intl. Rev. Cytol. 115:171-229 (1989), which is incorporated by reference herein in its entirety.

Any technique known in the art may be used to produce transgenic clones containing polynucleotides of the invention, for example, nuclear transfer into enucleated oocytes of nuclei from cultured embryonic, fetal, or adult cells induced to quiescence (Campell et al., Nature 380:64-66 (1996); Wilmut et al., Nature 385:810-813 (1997)).

The present invention provides for transgenic animals that carry the transgene in all their cells, as well as animals which carry the transgene in some, but not all their cells, i.e., mosaic animals or chimeric. The transgene may be integrated as a single transgene or as multiple copies such as in concatamers, e.g., head-to-head tandems or head-to-tail tandems. The transgene may also be selectively introduced into and activated in a particular cell type by following, for example, the teaching of Lasko et al. (Lasko et al., Proc. Natl. Acad. Sci. USA 89:6232-6236 (1992)). The regulatory sequences required for such a cell-type specific activation will depend upon the particular cell type of interest, and will be apparent to those of skill in the art. When it is desired that the polynucleotide transgene be integrated into the chromosomal site of the endogenous gene, gene targeting is preferred. Briefly, when such a technique is to be utilized, vectors containing some nucleotide sequences homologous to the endogenous gene are designed for the purpose of integrating, via homologous recombination with chromosomal sequences, into and disrupting the function of the nucleotide sequence of the endogenous gene. The transgene may also be selectively introduced into a particular cell type, thus inactivating the endogenous gene in only that cell type, by following, for example, the teaching of Gu et al. (Gu et al., Science 265: 103-106 (1994)). The regulatory sequences required for such a cell-type specific inactivation will depend upon the particular cell type of interest, and will be apparent to those of skill in the art.

Once transgenic animals have been generated, the expression of the recombinant gene may be assayed utilizing standard techniques. Initial screening may be accomplished by Southern blot analysis or PCR techniques to analyze animal tissues to verify that integration of the transgene has taken place. The level of mRNA expression of the transgene in the tissues of the transgenic animals may also be assessed using techniques which include, but are not limited to, Northern blot analysis of tissue samples obtained from the animal, in situ hybridization analysis, and reverse transcriptase-PCR (rt-PCR). Samples of transgenic gene-expressing tissue may also be evaluated immunocytochemically or immunohistochemically using antibodies specific for the transgene product.

Once the founder animals are produced, they may be bred, inbred, outbred, or crossbred to produce colonies of the particular animal. Examples of such breeding strategies include, but are not limited to: outbreeding of founder animals with more than one integration site in order to establish separate lines; inbreeding of separate lines in order to produce compound transgenics that express the transgene at higher levels because of the effects of additive expression of each transgene; crossing of heterozygous transgenic animals to produce animals homozygous for a given integration site in order to both augment expression and eliminate the need for screening of animals by DNA analysis; crossing of separate homozygous lines to produce compound heterozygous or homozygous lines; and breeding to place the transgene on a distinct background that is appropriate for an experimental model of interest.

Transgenic animals of the invention have uses which include, but are not limited to, animal model systems useful in elaborating the biological function of polypeptides of the present invention, studying diseases, disorders, and/or conditions associated with aberrant expression, and in screening for compounds effective in ameliorating such diseases, disorders, and/or conditions.

Example 30

Knock-Out Animals

Endogenous gene expression can also be reduced by inactivating or "knocking out" the gene and/or its promoter using targeted homologous recombination. (E.g., see Smithies et al., Nature 317:230-234 (1985); Thomas & Capecchi, Cell 51:503-512 (1987); Thompson et al., Cell 5:313-321 (1989); each of which is incorporated by reference herein in its entirety). For example, a mutant, non-functional polynucleotide of the invention (or a completely unrelated DNA sequence) flanked by DNA homologous to the endogenous polynucleotide sequence (either the coding regions or regulatory regions of the gene) can be used, with or without a selectable marker and/or a negative selectable marker, to transfect cells that express polypeptides of the invention in vivo. In another embodiment, techniques known in the art are used to generate knockouts in cells that contain, but do not express the gene of interest. Insertion of the DNA construct, via targeted homologous recombination, results in inactivation of the targeted gene. Such approaches are particularly suited in research and agricultural fields where modifications to embryonic stem cells can be used to generate animal offspring with an inactive targeted gene (e.g., see Thomas & Capecchi 1987 and Thompson 1989, supra). However this approach can be routinely adapted for use in humans provided the recombinant DNA constructs are directly administered or targeted to the required site in vivo using appropriate viral vectors that will be apparent to those of skill in the art.

In further embodiments of the invention, cells that are genetically engineered to express the polypeptides of the invention, or alternatively, that are genetically engineered not to express the polypeptides of the invention (e.g., knockouts) are administered to a patient in vivo. Such cells may be obtained from the patient (i.e., animal, including human) or an MHC compatible donor and can include, but are not limited to fibroblasts, bone marrow cells, blood cells (e.g., lymphocytes), adipocytes, muscle cells, endothelial cells etc. The cells are genetically engineered in vitro using recombinant DNA techniques to introduce the coding sequence of polypeptides of the invention into the cells, or alternatively, to disrupt the coding sequence and/or endogenous regulatory sequence associated with the polypeptides of the invention, e.g., by transduction (using viral vectors, and preferably vectors that integrate the transgene into the cell genome) or transfection procedures, including, but not limited to, the use of plasmids, cosmids, YACs, naked DNA, electroporation, liposomes, etc. The coding sequence of the polypeptides of the invention can be placed under the control of a strong constitutive or inducible promoter or promoter/enhancer to achieve expression, and preferably secretion, of the polypeptides of the invention. The engineered cells which express and preferably secrete the polypeptides of the invention can be introduced into the patient systemically, e.g., in the circulation, or intraperitoneally.

Alternatively, the cells can be incorporated into a matrix and implanted in the body, e.g., genetically engineered fibroblasts can be implanted as part of a skin graft; genetically engineered endothelial cells can be implanted as part of a lymphatic or vascular graft. (See, for example, Anderson et al. U.S. Pat. No. 5,399,349; and Mulligan & Wilson, U.S. Pat. No. 5,460,959 each of which is incorporated by reference herein in its entirety).

When the cells to be administered are non-autologous or non-MHC compatible cells, they can be administered using well known techniques which prevent the development of a host immune response against the introduced cells. For example, the cells may be introduced in an encapsulated form which, while allowing for an exchange of components with the immediate extracellular environment, does not allow the introduced cells to be recognized by the host immune system.

Transgenic and "knock-out" animals of the invention have uses which include, but are not limited to, animal model systems useful in elaborating the biological function of polypeptides of the present invention, studying diseases, disorders, and/or conditions associated with aberrant expression, and in screening for compounds effective in ameliorating such diseases, disorders, and/or conditions.

Example 31

Production of an Antibody

Hybridoma Technology

The antibodies of the present invention can be prepared by a variety of methods. (See, Current Protocols, Chapter 2.) As one example of such methods, cells expressing polypeptide(s) of the invention are administered to an animal to induce the production of sera containing polyclonal antibodies. In a preferred method, a preparation of polypeptide(s) of the invention is prepared and purified to render it substantially free of natural contaminants. Such a preparation is then introduced into an animal in order to produce polyclonal antisera of greater specific activity.

Monoclonal antibodies specific for polypeptide(s) of the invention are prepared using hybridoma technology. (Kohler et al., Nature 256:495 (1975); Kohler et al., Eur. J. Immunol. 6.511 (1976); Kohler et al., Eur. J. Immunol. 6.292 (1976); Hammerling et al., in: Monoclonal Antibodies and T-Cell Hybridomas, Elsevier, N.Y., pp. 563-681 (1981)). In general, an animal (preferably a mouse) is immunized with polypeptide(s) of the invention, or, more preferably, with a secreted polypeptide-expressing cell. Such polypeptide-expressing cells are cultured in any suitable tissue culture medium, preferably in Earle's modified Eagle's medium supplemented with 10% fetal bovine serum (inactivated at about 56° C.), and supplemented with about 10 g/l of nonessential amino acids, about 1,000 U/ml of penicillin, and about 100 µg/ml of streptomycin.

The splenocytes of such mice are extracted and fused with a suitable myeloma cell line. Any suitable myeloma cell line may be employed in accordance with the present invention; however, it is preferable to employ the parent myeloma cell line (SP20), available from the ATCC. After fusion, the resulting hybridoma cells are selectively maintained in HAT medium, and then cloned by limiting dilution as described by Wands et al. (Gastroenterology 80:225-232 (1981)). The hybridoma cells obtained through such a selection are then assayed to identify clones which secrete antibodies capable of binding the polypeptide(s) of the invention.

Alternatively, additional antibodies capable of binding polypeptide(s) of the invention can be produced in a two-step procedure using anti-idiotypic antibodies. Such a method makes use of the fact that antibodies are themselves antigens, and therefore, it is possible to obtain an antibody which binds to a second antibody. In accordance with this method, protein specific antibodies are used to immunize an animal, preferably a mouse. The splenocytes of such an animal are then used to produce hybridoma cells, and the hybridoma cells are screened to identify clones which produce an antibody whose ability to bind to the polypeptide(s) of the invention protein-specific antibody can be blocked by polypeptide(s) of the invention. Such antibodies comprise anti-idiotypic antibodies to the polypeptide(s) of the invention protein-specific antibody and are used to immunize an animal to induce formation of further polypeptide(s) of the invention protein-specific antibodies.

For in vivo use of antibodies in humans, an antibody is "humanized". Such antibodies can be produced using genetic constructs derived from hybridoma cells producing the monoclonal antibodies described above. Methods for producing chimeric and humanized antibodies are known in the art and are discussed herein. (See, for review, Morrison, Science 229:1202 (1985); Oi et al., BioTechniques 4:214 (1986); Cabilly et al., U.S. Pat. No. 4,816,567; Taniguchi et al., EP 171496; Morrison et al., EP 173494; Neuberger et al., WO 8601533; Robinson et al., WO 8702671; Boulianne et al., Nature 312:643 (1984); Neuberger et al., Nature 314:268 (1985).)

Isolation Of Antibody Fragments Directed polypeptide(s) of the Invention From A Library Of scFvs Naturally occurring V-genes isolated from human PBLs are constructed into a library of antibody fragments which contain reactivities against polypeptide(s) of the invention to which the donor may or may not have been exposed (see e.g., U.S. Pat. No. 5,885,793 incorporated herein by reference in its entirety).

Rescue of the Library. A library of scFvs is constructed from the RNA of human PBLs as described in PCT publication WO 92/01047. To rescue phage displaying antibody fragments, approximately 109 $E.\ coli$ harboring the phagemid are used to inoculate 50 ml of 2×TY containing 1% glucose and 100 µg/ml of ampicillin (2×TY-AMP-GLU) and grown to an O.D. of 0.8 with shaking. Five ml of this culture is used to innoculate 50 ml of 2×TY-AMP-GLU, 2×108 TU of delta gene 3 helper (M13 delta gene III, see PCT publication WO 92/01047) are added and the culture incubated at 37° C. for 45 minutes without shaking and then at 37° C. for 45 minutes with shaking. The culture is centrifuged at 4000 r.p.m. for 10 min. and the pellet resuspended in 2 liters of 2×TY containing 100 μg/ml ampicillin and 50 ug/ml kanamycin and grown overnight. Phage are prepared as described in PCT publication WO 92/01047.

M13 delta gene III is prepared as follows: M13 delta gene III helper phage does not encode gene III protein, hence the phage(mid) displaying antibody fragments have a greater avidity of binding to antigen. Infectious M13 delta gene III particles are made by growing the helper phage in cells harboring a pUC19 derivative supplying the wild type gene III protein during phage morphogenesis. The culture is incubated for 1 hour at 37° C. without shaking and then for a further hour at 37° C. with shaking. Cells are spun down (IEC-Centra 8,400 r.p.m. for 10 min), resuspended in 300 ml 2×TY broth containing 100 μg ampicillin/ml and 25 μg kanamycin/ml (2×TY-AMP-KAN) and grown overnight, shaking at 37° C. Phage particles are purified and concentrated from the culture medium by two PEG-precipitations (Sambrook et al., 1990), resuspended in 2 ml PBS and passed through a 0.45 μm filter (Minisart NML; Sartorius) to give a final concentration of approximately 1013 transducing units/ml (ampicillin-resistant clones).

Panning of the Library Immunotubes (Nunc) are coated overnight in PBS with 4 ml of either 100 μg/ml or 10 μg/ml of a polypeptide of the present invention. Tubes are blocked with 2% Marvel-PBS for 2 hours at 37° C. and then washed 3 times in PBS. Approximately 1013 TU of phage is applied to the tube and incubated for 30 minutes at room temperature tumbling on an over and under turntable and then left to stand for another 1.5 hours. Tubes are washed 10 times with PBS 0.1% Tween-20 and 10 times with PBS. Phage are eluted by adding 1 ml of 100 mM triethylamine and rotating 15 minutes on an under and over turntable after which the solution is immediately neutralized with 0.5 ml of 1.0M Tris-HCl, pH 7.4. Phage are then used to infect 10 ml of mid-log $E.$ $coli$ TG1 by incubating eluted phage with bacteria for 30 minutes at 37° C. The $E.$ $coli$ are then plated on TYE plates containing 1% glucose and 100 μg/ml ampicillin. The resulting bacterial library is then rescued with delta gene 3 helper phage as described above to prepare phage for a subsequent round of selection. This process is then repeated for a total of 4 rounds of affinity purification with tube-washing increased to 20 times with PBS, 0.1% Tween-20 and 20 times with PBS for rounds 3 and 4.

Characterization of Binders. Eluted phage from the 3rd and 4th rounds of selection are used to infect $E.$ $coli$ HB 2151 and soluble scFv is produced (Marks, et al., 1991) from single colonies for assay. ELISAs are performed with microtitre plates coated with either 10 pg/ml of the polypeptide of the present invention in 50 mM bicarbonate pH 9.6. Clones positive in ELISA are further characterized by PCR fingerprinting (see, e.g., PCT publication WO 92/01047) and then by sequencing. These ELISA positive clones may also be further characterized by techniques known in the art, such as, for example, epitope mapping, binding affinity, receptor signal transduction, ability to block or competitively inhibit antibody/antigen binding, and competitive agonistic or antagonistic activity.

Example 32

Assays Detecting Stimulation or Inhibition of B cell Proliferation and Differentiation Generation of functional humoral immune responses requires both soluble and cognate signaling between B-lineage cells and their microenvironment. Signals may impart a positive stimulus that allows a B-lineage cell to continue its programmed development, or a negative stimulus that instructs the cell to arrest its current developmental pathway. To date, numerous stimulatory and inhibitory signals have been found to influence B cell responsiveness including IL-2, IL-4, IL-5, IL-6, IL-7, IL10, IL-13, IL-14 and IL-15. Interestingly, these signals are by themselves weak effectors but can, in combination with various co-stimulatory proteins, induce activation, proliferation, differentiation, homing, tolerance and death among B cell populations.

One of the best studied classes of B-cell co-stimulatory proteins is the TNF-superfamily. Within this family CD40, CD27, and CD30 along with their respective ligands CD154, CD70, and CD153 have been found to regulate a variety of immune responses. Assays which allow for the detection and/or observation of the proliferation and differentiation of these B-cell populations and their precursors are valuable tools in determining the effects various proteins may have on these B-cell populations in terms of proliferation and differentiation. Listed below are two assays designed to allow for the detection of the differentiation, proliferation, or inhibition of B-cell populations and their precursors.

In Vitro Assay—Purified polypeptides of the invention, or truncated forms thereof, is assessed for its ability to induce activation, proliferation, differentiation or inhibition and/or death in B-cell populations and their precursors. The activity of the polypeptides of the invention on purified human tonsillar B cells, measured qualitatively over the dose range from 0.1 to 10,000 ng/mL, is assessed in a standard B-lymphocyte co-stimulation assay in which purified tonsillar B cells are cultured in the presence of either formalin-fixed $Staphylococcus$ $aureus$ Cowan I (SAC) or immobilized anti-human IgM antibody as the priming agent. Second signals such as IL-2 and IL-15 synergize with SAC and IgM crosslinking to elicit B cell proliferation as measured by tritiated-thymidine incorporation. Novel synergizing agents can be readily identified using this assay. The assay involves isolating human tonsillar B cells by magnetic bead (MACS) depletion of CD3-positive cells. The resulting cell population is greater than 95% B cells as assessed by expression of CD45R(B220).

Various dilutions of each sample are placed into individual wells of a 96-well plate to which are added $10^5$ B-cells suspended in culture medium (RPMI 1640 containing 10% FBS, $5\times10^{-5}$M 2ME, 100 U/ml penicillin, 10 ug/ml streptomycin, and $10^{-5}$ dilution of SAC) in a total volume of 150 ul. Proliferation or inhibition is quantitated by a 20 h pulse (1 uCi/well) with 3H-thymidine (6.7 Ci/mM) beginning 72 h post factor addition. The positive and negative controls are IL2 and medium respectively.

In Vivo Assay—BALB/c mice are injected (i.p.) twice per day with buffer only, or 2 mg/Kg of a polypeptide of the invention, or truncated forms thereof. Mice receive this treatment for 4 consecutive days, at which time they are sacrificed and various tissues and serum collected for analyses. Comparison of H&E sections from normal spleens and spleens treated with polypeptides of the invention identify the results of the activity of the polypeptides on spleen cells, such as the diffusion of pen-arterial lymphatic sheaths, and/or significant increases in the nucleated cellularity of the red pulp regions, which may indicate the activation of the differentiation and proliferation of B-cell populations. Immunohistochemical studies using a B cell marker, anti-CD45R(B220), are used to determine whether any physiological changes to splenic cells, such as splenic disorganization, are due to increased B-cell representation within loosely defined B-cell zones that infiltrate established T-cell regions.

Flow cytometric analyses of the spleens from mice treated with polypeptide is used to indicate whether the polypeptide specifically increases the proportion of ThB+, CD45R(B220) dull B cells over that which is observed in control mice.

Likewise, a predicted consequence of increased mature B-cell representation in vivo is a relative increase in serum Ig titers. Accordingly, serum IgM and IgA levels are compared between buffer and polypeptide-treated mice.

The studies described in this example tested activity of a polypeptide of the invention. However, one skilled in the art could easily modify the exemplified studies to test the activity of polynucleotides of the invention (e.g., gene therapy), agonists, and/or antagonists of polynucleotides or polypeptides of the invention.

Example 33

T Cell Proliferation Assay

Proliferation Assay for Resting PBLs.

A CD3-induced proliferation assay is performed on PBMCs and is measured by the uptake of $^3$H-thymidine. The assay is performed as follows. Ninety-six well plates are coated with 100 microliters per well of mAb to CD3 (HIT3a, Pharmingen) or isotype-matched control mAb (B33.1) overnight at 4° C. (1 microgram/ml in 0.05M bicarbonate buffer, pH 9.5), then washed three times with PBS. PBMC are isolated by F/H gradient centrifugation from human peripheral blood and added to quadruplicate wells ($5 \times 10^4$/well) of mAb coated plates in RPMI containing 10% FCS and P/S in the presence of varying concentrations of TNF Delta and/or TNF Epsilon protein (total volume 200 microliters). Relevant protein buffer and medium alone are controls. After 48 hr. culture at 37° C., plates are spun for 2 min. at 1000 rpm and 100 microliters of supernatant is removed and stored –20° C. for measurement of IL-2 (or other cytokines) if effect on proliferation is observed. Wells are supplemented with 100 microliters of medium containing 0.5 microcuries of $^3$H-thymidine and cultured at 37° C. for 18-24 hr. Wells are harvested and incorporation of $^3$H-thymidine used as a measure of proliferation. Anti-CD3 alone is the positive control for proliferation. IL-2 (100 U/ml) is also used as a control which enhances proliferation. Control antibody which does not induce proliferation of T cells is used as the negative controls for the effects of TNF Delta and/or TNF Epsilon proteins.

Alternatively, a proliferation assay on resting PBL (peripheral blood lymphocytes) is measured by the up-take of $^3$H-thymidine. The assay is performed as follows. PBMC are isolated by Ficoll (LSM, ICN Biotechnologies, Aurora, Ohio) gradient centrifugation from human peripheral blood, and are cultured overnight in 10% (Fetal Calf Serum, Biofluids, Rockville, Md.)/RPMI (Gibco BRL, Gaithersburg, Md.). This overnight incubation period allows the adherent cells to attach to the plastic, which results in a lower background in the assay as there are fewer cells that can act as antigen presenting cells or that might be producing growth factors. The following day the non-adherent cells are collected, washed and used in the proliferation assay. The assay is performed in a 96 well plate using $2 \times 10^4$ cells/well in a final volume of 200 microliters. The supernatants (e.g., CHO or 293T supernatants) expressing the protein of interest are tested at a 30% final dilution, therefore 60 ul are added to 140 ul of 10% FCS/RPMI containing the cells. Control supernatants are used at the same final dilution and express the following proteins: vector (negative control), IL-2 (*), IFN-gamma, TNF-alpha, IL-10 and TR2. In addition to the control supernatants, recombinant human IL-2 (R & D Systems, Minneapolis, Minn.) at a final concentration of 100 ng/ml is also used. After 24 hours of culture, each well is pulsed with 1 uCi of $^3$H-thymidine (Nen, Boston, Mass.). Cells are then harvested 20 hours following pulsing and incorporation of $^3$H-thymidine is used as a measure of proliferation. Results are expressed as an average of triplicate samples plus or minus standard error.

(*) The amount of the control cytokines IL-2, IFN-gamma, TNF-alpha and IL-10 produced in each transfection varies between 300 pg to 5 ng/ml.

Costimulation Assay.

A costimulation assay on resting PBL (peripheral blood lymphocytes) is performed in the presence of immobilized antibodies to CD3 and CD28. The use of antibodies specific for the invariant regions of CD3 mimic the induction of T cell activation that would occur through stimulation of the T cell receptor by an antigen. Cross-linking of the TCR (first signal) in the absence of a costimulatory signal (second signal) causes very low induction of proliferation and will eventually result in a state of "anergy", which is characterized by the absence of growth and inability to produce cytokines. The addition of a costimulatory signal such as an antibody to CD28, which mimics the action of the costimulatory molecule. B7-1 expressed on activated APCs, results in enhancement of T cell responses including cell survival and production of IL-2. Therefore this type of assay allows to detect both positive and negative effects caused by addition of supernatants expressing the proteins of interest on T cell proliferation.

The assay is performed as follows. Ninety-six well plates are coated with 100 ng/ml anti-CD3 and 5 ug/ml anti-CD28 (Pharmingen, San Diego, Calif.) in a final volume of 100 ul and incubated overnight at 4C. Plates are washed twice with PBS before use. PBMC are isolated by Ficoll (LSM, ICN Biotechnologies, Aurora, Ohio) gradient centrifugation from human peripheral blood, and are cultured overnight in 10% FCS (Fetal Calf Serum, Biofluids, Rockville, Md.)/RPMI (Gibco BRL, Gaithersburg, Md.). This overnight incubation period allows the adherent cells to attach to the plastic, which results in a lower background in the assay as there are fewer cells that can act as antigen presenting cells or that might be producing growth factors. The following day the non adherent cells are collected, washed and used in the proliferation assay. The assay is performed in a 96 well plate using $2 \times 10^4$ cells/well in a final volume of 200 ul. The supernatants (e.g., CHO or 293T supernatants) expressing the protein of interest are tested at a 30% final dilution, therefore 60 ul are added to 140 ul of 10% FCS/RPMI containing the cells. Control supernatants are used at the same final dilution and express the following proteins: vector only (negative control), IL-2, IFN-gamma, TNF-alpha, IL-10 and TR2. In addition to the control supernatants recombinant human IL-2 (R & D Systems, Minneapolis, Minn.) at a final concentration of 10 ng/m$^1$ is also used. After 24 hours of culture, each well is pulsed with 1 uCi of $^3$H-thymidine (Nen, Boston, Mass.). Cells are then harvested 20 hours following pulsing and incorporation of $^3$H-thymidine is used as a measure of proliferation. Results are expressed as an average of triplicate samples plus or minus standard error.

Costimulation Assay: IFN-Gamma and IL-2 ELISA.

The assay is performed as follows. Twenty-four well plates are coated with either 300 ng/ml or 600 ng/ml anti-CD3 and 5 ug/ml anti-CD28 (Pharmingen, San Diego, Calif.) in a final volume of 500 ul and incubated overnight at 4C. Plates are washed twice with PBS before use. PBMC are isolated by Ficoll (LSM, ICN Biotechnologies, Aurora, Ohio) gradient centrifugation from human peripheral blood, and are cultured overnight in 10% FCS (Fetal Calf Serum, Biofluids, Rockville, Md.)/RPMI (Gibco BRL, Gaithersburg, Md.). This overnight incubation period allows the adherent cells to attach to the plastic, which results in a lower background in the assay as there are fewer cells that can act as antigen presenting cells or that might be producing growth factors. The following day the non adherent cells are collected, washed and used in the costimulation assay. The assay is performed in the pre-coated twenty-four well plate using $1 \times 10^5$ cells/well in a final volume of 900 ul. The supernatants (293T supernatants) expressing the protein of interest are tested at a 30% final dilution, therefore 300 ul are added to 600 ul of 10% FCS/RPMI containing the cells. Control supernatants are used at the same final dilution and express the following proteins: vector only (negative control), IL-2, IFN-gamma, IL-12 and IL-18. In addition to the control supernatants recombinant human IL-2 (all cytokines were purchased from R & D Systems, Minneapolis, Minn.) at a final concentration of 10 ng/ml, IL-12 at a final concentration of 1 ng/ml and IL-18 at a final concentration of 50 ng/ml are also used. Controls and unknown samples are tested in duplicate. Supernatant samples (250 ul) are collected 2 days and 5 days after the beginning of the assay. ELISAs to test for IFN-gamma and IL-2 secretion are performed using kits purchased from R & D Systems, (Minneapolis, Minn.). Results are expressed as an average of duplicate samples plus or minus standard error.

Proliferation Assay for Preactivated-Resting T Cells.

A proliferation assay on preactivated-resting T cells is performed on cells that are previously activated with the lectin phytohemagglutinin (PHA). Lectins are polymeric plant proteins that can bind to residues on T cell surface glycoproteins including the TCR and act as polyclonal activators. PBLs treated with PHA and then cultured in the presence of low doses of IL-2 resemble effector T cells. These cells are generally more sensitive to further activation induced by growth factors such as IL-2. This is due to the expression of high affinity IL-2 receptors that allows this population to respond to amounts of IL-2 that are 100 fold lower than what would have an effect on a naive T cell. Therefore the use of this type of cells might enable to detect the effect of very low doses of an unknown growth factor, that would not be sufficient to induce proliferation on resting (naive)) T cells.

The assay is performed as follows. PBMC are isolated by F/H gradient centrifugation from human peripheral blood, and are cultured in 10% FCS (Fetal Calf Serum, Biofluids, Rockville, Md.)/RPMI (Gibco BRL, Gaithersburg, Md.) in the presence of 2 ug/ml PHA (Sigma, Saint Louis, Mo.) for three days. The cells are then washed in PBS and cultured in 10% FCS/RPMI in the presence of 5 ng/ml of human recombinant IL-2 (R & D Systems, Minneapolis, Minn.) for 3 days. The cells are washed and rested in starvation medium (1% FCS/RPMI) for 16 hours prior to the beginning of the proliferation assay. An aliquot of the cells is analyzed by FACS to determine the percentage of T cells (CD3 positive cells) present; this usually ranges between 93-97% depending on the donor. The assay is performed in a 96 well plate using $2 \times 10^4$ cells/well in a final volume of 200 ul. The supernatants (e.g., CHO or 293T supernatants) expressing the protein of interest are tested at a 30% final dilution, therefore 60 ul are added to 140 ul of in 10% FCS/RPMI containing the cells. Control supernatants are used at the same final dilution and express the following proteins: vector (negative control), IL-2, IFN-gamma, TNF-alpha, IL-10 and TR2. In addition to the control supernatants recombinant human IL-2 at a final concentration of 10 ng/ml is also used. After 24 hours of culture, each well is pulsed with 1 uCi of $^3$H-thymidine (Nen, Boston, Mass.). Cells are then harvested 20 hours following pulsing and incorporation of $^3$H-thymidine is used as a measure of proliferation. Results are expressed as an average of triplicate samples plus or minus standard error.

The studies described in this example test activity of polypeptides of the invention. However, one skilled in the art could easily modify the exemplified studies to test the activity of polynucleotides of the invention (e.g., gene therapy), agonists, and/or antagonists of polynucleotides or polypeptides of the invention.

Example 34

Effect of Polypeptides of the Invention on the Expression of MHC Class II, Costimulatory and Adhesion Molecules and Cell Differentiation of Monocytes and Monocyte-Derived Human Dendritic Cells Dendritic cells are generated by the expansion of proliferating precursors found in the peripheral blood: adherent PBMC or elutriated monocytic fractions are cultured for 7-10 days with GM-CSF (50 ng/ml) and IL-4 (20 ng/ml). These dendritic cells have the characteristic phenotype of immature cells (expression of CD1, CD80, CD86, CD40 and MHC class II antigens). Treatment with activating factors, such as TNF-alpha, causes a rapid change in surface phenotype (increased expression of MHC class I and II, costimulatory and adhesion molecules, downregulation of FCγRII, upregulation of CD83). These changes correlate with increased antigen-presenting capacity and with functional maturation of the dendritic cells.

FACS analysis of surface antigens is performed as follows. Cells are treated 1-3 days with increasing concentrations of polypeptides of the invention or LPS (positive control), washed with PBS containing 1% BSA and 0.02 mM sodium azide, and then incubated with 1:20 dilution of appropriate FITC- or PE-labeled monoclonal antibodies for 30 minutes at 4 degrees C. After an additional wash, the labeled cells are analyzed by flow cytometry on a FACScan (Becton Dickinson).

Effect on the production of cytokines. Cytokines generated by dendritic cells, in particular IL-12, are important in the initiation of T-cell dependent immune responses. IL-12 strongly influences the development of Th1 helper T-cell immune response, and induces cytotoxic T and NK cell function. An ELISA is used to measure the IL-12 release as follows. Dendritic cells ($10^6$/ml) are treated with increasing concentrations of polypeptides of the invention for 24 hours. LPS (100 ng/ml) is added to the cell culture as positive control. Supernatants from the cell cultures are then collected and analyzed for IL-12 content using commercial ELISA kit (e.g, R & D Systems (Minneapolis, Minn.)). The standard protocols provided with the kits are used.

Effect on the expression of MHC Class II, costimulatory and adhesion molecules. Three major families of cell surface antigens can be identified on monocytes: adhesion molecules, molecules involved in antigen presentation, and Fc receptor. Modulation of the expression of MHC class II antigens and other costimulatory molecules, such as B7 and ICAM-1, may result in changes in the antigen presenting capacity of monocytes and ability to induce T cell activation. Increase expression of Fc receptors may correlate with improved monocyte cytotoxic activity, cytokine release and phagocytosis.

FACS analysis is used to examine the surface antigens as follows. Monocytes are treated 1-5 days with increasing concentrations of polypeptides of the invention or LPS (positive control), washed with PBS containing 1% BSA and 0.02 mM sodium azide, and then incubated with 1:20 dilution of appropriate FITC- or PE-labeled monoclonal antibodies for 30 minutes at 4 degreesC. After an additional wash, the labeled cells are analyzed by flow cytometry on a FACScan (Becton Dickinson).

Monocyte activation and/or increased survival. Assays for molecules that activate (or alternatively, inactivate) monocytes and/or increase monocyte survival (or alternatively, decrease monocyte survival) are known in the art and may routinely be applied to determine whether a molecule of the invention functions as an inhibitor or activator of monocytes. Polypeptides, agonists, or antagonists of the invention can be screened using the three assays described below. For each of these assays, Peripheral blood mononuclear cells (PBMC) are purified from single donor leukopacks (American Red Cross, Baltimore, Md.) by centrifugation through a Histopaque gradient (Sigma). Monocytes are isolated from PBMC by counterflow centrifugal elutriation.

Monocyte Survival Assay. Human peripheral blood monocytes progressively lose viability when cultured in absence of serum or other stimuli. Their death results from internally regulated process (apoptosis). Addition to the culture of activating factors, such as TNF-alpha dramatically improves cell survival and prevents DNA fragmentation. Propidium iodide (PI) staining is used to measure apoptosis as follows. Monocytes are cultured for 48 hours in polypropylene tubes in serum-free medium (positive control), in the presence of 100 ng/ml TNF-alpha (negative control), and in the presence of varying concentrations of the compound to be tested. Cells are suspended at a concentration of $2\times10^6$/ml in PBS containing PI at a final concentration of 5 µg/ml, and then incubaed at room temperature for 5 minutes before FACScan analysis. PI uptake has been demonstrated to correlate with DNA fragmentation in this experimental paradigm.

Effect on cytokine release. An important function of monocytes/macrophages is their regulatory activity on other cellular populations of the immune system through the release of cytokines after stimulation. An ELISA to measure cytokine release is performed as follows. Human monocytes are incubated at a density of $5\times10^5$ cells/ml with increasing concentrations of the a polypeptide of the invention and under the same conditions, but in the absence of the polypeptide. For IL-12 production, the cells are primed overnight with IFN (100 U/ml) in presence of a polypeptide of the invention. LPS (10 ng/ml) is then added. Conditioned media are collected after 24 h and kept frozen until use. Measurement of TNF-alpha, IL-10, MCP-1 and IL-8 is then performed using a commercially available ELISA kit (e.g, R & D Systems (Minneapolis, Minn.)) and applying the standard protocols provided with the kit.

Oxidative burst. Purified monocytes are plated in 96-w plate at $2-1\times10^5$ cell/well. Increasing concentrations of polypeptides of the invention are added to the wells in a total volume of 0.2 ml culture medium (RPMI 1640+10% FCS, glutamine and antibiotics). After 3 days incubation, the plates are centrifuged and the medium is removed from the wells. To the macrophage monolayers, 0.2 ml per well of phenol red solution (140 mM NaCl, 10 mM potassium phosphate buffer pH 7.0, 5.5 mM dextrose, 0.56 mM phenol red and 19 U/ml of HRPO) is added, together with the stimulant (200 nM PMA). The plates are incubated at 37° C. for 2 hours and the reaction is stopped by adding 20 µl 1N NaOH per well. The absorbance is read at 610 nm. To calculate the amount of $H_2O_2$ produced by the macrophages, a standard curve of a $H_2O_2$ solution of known molarity is performed for each experiment.

The studies described in this example tested activity of a polypeptide of the invention. However, one skilled in the art could easily modify the exemplified studies to test the activity of polypeptides, polynucleotides (e.g., gene therapy), agonists, and/or antagonists of the invention.

Example 35

Biological Effects of Polypeptides of the Invention

Astrocyte and Neuronal Assays

Recombinant polypeptides of the invention, expressed in *Escherichia coli* and purified as described above, can be tested for activity in promoting the survival, neurite outgrowth, or phenotypic differentiation of cortical neuronal cells and for inducing the proliferation of glial fibrillary acidic protein immunopositive cells, astrocytes. The selection of cortical cells for the bioassay is based on the prevalent expression of FGF-1 and FGF-2 in cortical structures and on the previously reported enhancement of cortical neuronal survival resulting from FGF-2 treatment. A thymidine incorporation assay, for example, can be used to elucidate a polypeptide of the invention's activity on these cells.

Moreover, previous reports describing the biological effects of FGF-2 (basic FGF) on cortical or hippocampal neurons in vitro have demonstrated increases in both neuron survival and neurite outgrowth (Walicke et al., "Fibroblast growth factor promotes survival of dissociated hippocampal neurons and enhances neurite extension." *Proc. Natl. Acad. Sci. USA* 83:3012-3016. (1986), assay herein incorporated by reference in its entirety). However, reports from experiments done on PC-12 cells suggest that these two responses are not necessarily synonymous and may depend on not only which FGF is being tested but also on which receptor(s) are expressed on the target cells. Using the primary cortical neuronal culture paradigm, the ability of a polypeptide of the invention to induce neurite outgrowth can be compared to the response achieved with FGF-2 using, for example, a thymidine incorporation assay.

Fibroblast and Endothelial Cell Assays

Human lung fibroblasts are obtained from Clonetics (San Diego, Calif.) and maintained in growth media from Clonetics. Dermal microvascular endothelial cells are obtained from Cell Applications (San Diego, Calif.). For proliferation assays, the human lung fibroblasts and dermal microvascular endothelial cells can be cultured at 5,000 cells/well in a 96-well plate for one day in growth medium. The cells are then incubated for one day in 0.1% BSA basal medium. After replacing the medium with fresh 0.1% BSA medium, the cells are incubated with the test proteins for 3 days. Alamar Blue (Alamar Biosciences, Sacramento, Calif.) is added to each well to a final concentration of 10%. The cells are incubated for 4 hr. Cell viability is measured by reading in a CytoFluor fluorescence reader. For the $PGE_2$ assays, the human lung fibroblasts are cultured at 5,000 cells/well in a 96-well plate for one day. After a medium change to 0.1% BSA basal medium, the cells are incubated with FGF-2 or polypeptides of the invention with or without IL-1α for 24 hours. The supernatants are collected and assayed for $PGE_2$ by EIA kit (Cayman, Ann Arbor, Mich.). For the IL-6 assays, the human lung fibroblasts are cultured at 5,000 cells/well in a 96-well plate for one day. After a medium change to 0.1% BSA basal medium, the cells are incubated with FGF-2 or with or without polypeptides of the invention IL-1 alpha for 24 hours. The supernatants are collected and assayed for IL-6 by ELISA kit (Endogen, Cambridge, Mass.).

Human lung fibroblasts are cultured with FGF-2 or polypeptides of the invention for 3 days in basal medium before the addition of Alamar Blue to assess effects on growth of the fibroblasts. FGF-2 should show a stimulation at 10-2500 ng/ml which can be used to compare stimulation with polypeptides of the invention.

Parkinson Models.

The loss of motor function in Parkinson's disease is attributed to a deficiency of striatal dopamine resulting from the degeneration of the nigrostriatal dopaminergic projection neurons. An animal model for Parkinson's that has been extensively characterized involves the systemic administration of 1-methyl-4 phenyl 1,2,3,6-tetrahydropyridine (MPTP). In the CNS, MPTP is taken-up by astrocytes and catabolized by monoamine oxidase B to 1-methyl-4-phenyl pyridine (MPP$^+$) and released. Subsequently, MPP is actively accumulated in dopaminergic neurons by the high-affinity reuptake transporter for dopamine. MPP is then concentrated in mitochondria by the electrochemical gradient and selectively inhibits nicotidamide adenine disphosphate: ubiquinone oxidoreductionase (complex I), thereby interfering with electron transport and eventually generating oxygen radicals.

It has been demonstrated in tissue culture paradigms that FGF-2 (basic FGF) has trophic activity towards nigral dopaminergic neurons (Ferrari et al., Dev. Biol. 1989). Recently, Dr. Unsicker's group has demonstrated that administering FGF-2 in gel foam implants in the striatum results in the near complete protection of nigral dopaminergic neurons from the toxicity associated with MPTP exposure (Otto and Unsicker, J. Neuroscience, 1990).

Based on the data with FGF-2, polypeptides of the invention can be evaluated to determine whether it has an action similar to that of FGF-2 in enhancing dopaminergic neuronal survival in vitro and it can also be tested in vivo for protection of dopaminergic neurons in the striatum from the damage associated with MPTP treatment. The potential effect of a polypeptide of the invention is first examined in vitro in a dopaminergic neuronal cell culture paradigm. The cultures are prepared by dissecting the midbrain floor plate from gestation day 14 Wistar rat embryos. The tissue is dissociated with trypsin and seeded at a density of 200,000 cells/cm$^2$ on polyorthinine-laminin coated glass coverslips. The cells are maintained in Dulbecco's Modified Eagle's medium and F12 medium containing hormonal supplements (N1). The cultures are fixed with paraformaldehyde after 8 days in vitro and are processed for tyrosine hydroxylase, a specific marker for dopminergic neurons, immunohistochemical staining Dissociated cell cultures are prepared from embryonic rats. The culture medium is changed every third day and the factors are also added at that time.

Since the dopaminergic neurons are isolated from animals at gestation day 14, a developmental time which is past the stage when the dopaminergic precursor cells are proliferating, an increase in the number of tyrosine hydroxylase immunopositive neurons would represent an increase in the number of dopaminergic neurons surviving in vitro. Therefore, if a polypeptide of the invention acts to prolong the survival of dopaminergic neurons, it would suggest that the polypeptide may be involved in Parkinson's Disease.

The studies described in this example tested activity of a polypeptide of the invention. However, one skilled in the art could easily modify the exemplified studies to test the activity of polynucleotides (e.g., gene therapy), agonists, and/or antagonists of the invention.

Example 36

The Effect of Polypeptides of the Invention on the Growth of Vascular Endothelial Cells On day 1, human umbilical vein endothelial cells (HUVEC) are seeded at 2-5×10$^4$ cells/35 mm dish density in M199 medium containing 4% fetal bovine serum (FBS), 16 units/ml heparin, and 50 units/ml endothelial cell growth supplements (ECGS, Biotechnique, Inc.). On day 2, the medium is replaced with M199 containing 10% FBS, 8 units/ml heparin. A polypeptide having the amino acid sequence of SEQ ID NO:Y, and positive controls, such as VEGF and basic FGF (bFGF) are added, at varying concentrations. On days 4 and 6, the medium is replaced. On day 8, cell number is determined with a Coulter Counter.

An increase in the number of HUVEC cells indicates that the polypeptide of the invention may proliferate vascular endothelial cells.

The studies described in this example tested activity of a polypeptide of the invention. However, one skilled in the art could easily modify the exemplified studies to test the activity of polynucleotides (e.g., gene therapy), agonists, and/or antagonists of the invention.

Example 37

Stimulatory Effect of Polypeptides of the Invention on the Proliferation of Vascular Endothelial Cells For evaluation of mitogenic activity of growth factors, the colorimetric MTS (3-(4,5-dimethylthiazol-2-yl)-5-(3-carboxymethoxyphenyl)-2-(4-sulfophenyl)$_2$H-tetrazolium) assay with the electron coupling reagent PMS (phenazine methosulfate) was performed (CellTiter 96 AQ, Promega). Cells are seeded in a 96-well plate (5,000 cells/well) in 0.1 mL serum-supplemented medium and are allowed to attach overnight. After serum-starvation for 12 hours in 0.5% FBS, conditions (bFGF, VEGF$_{165}$ or a polypeptide of the invention in 0.5% FBS) with or without Heparin (8 U/ml) are added to wells for 48 hours. 20 mg of MTS/PMS mixture (1:0.05) are added per well and allowed to incubate for 1 hour at 37° C. before measuring the absorbance at 490 nm in an ELISA plate reader. Background absorbance from control wells (some media, no cells) is subtracted, and seven wells are performed in parallel for each condition. See, Leak et al. *In Vitro Cell. Dev. Biol.* 30A:512-518 (1994).

The studies described in this example tested activity of a polypeptide of the invention. However, one skilled in the art could easily modify the exemplified studies to test the activity of polynucleotides (e.g., gene therapy), agonists, and/or antagonists of the invention.

Example 38

Inhibition of PDGF-induced Vascular Smooth Muscle Cell Proliferation Stimulatory Effect HAoSMC proliferation can be measured, for example, by BrdUrd incorporation. Briefly, subconfluent, quiescent cells grown on the 4-chamber slides are transfected with CRP or FITC-labeled AT2-3LP. Then, the cells are pulsed with 10% calf serum and 6 mg/ml BrdUrd. After 24 h, immunocytochemistry is performed by using BrdUrd Staining Kit (Zymed Laboratories). In brief, the cells are incubated with the biotinylated mouse anti-BrdUrd antibody at 4 degrees C. for 2 h after being exposed to denaturing solution and then incubated with the streptavidin-peroxidase and diaminobenzidine. After counterstaining with hematoxylin, the cells are mounted for microscopic examination, and the BrdUrd-positive cells are counted. The BrdUrd index is calculated as a percent of the BrdUrd-positive cells to the total cell number. In addition, the simultaneous detection of the BrdUrd staining (nucleus) and the FITC uptake (cytoplasm) is performed for individual cells by the concomitant use of bright field illumination and dark field-UV fluorescent illumination. See, Hayashida et al., J. Biol. Chem. 6:271(36):21985-21992 (1996).

The studies described in this example tested activity of a polypeptide of the invention. However, one skilled in the art could easily modify the exemplified studies to test the activity of polynucleotides (e.g., gene therapy), agonists, and/or antagonists of the invention.

Example 39

Stimulation of Endothelial Migration

This example will be used to explore the possibility that a polypeptide of the invention may stimulate lymphatic endothelial cell migration.

Endothelial cell migration assays are performed using a 48 well microchemotaxis chamber (Neuroprobe Inc., Cabin John, Md.; Falk, W., et al., J. Immunological Methods 1980; 33:239-247). Polyvinylpyrrolidone-free polycarbonate filters with a pore size of 8 um (Nucleopore Corp. Cambridge, Mass.) are coated with 0.1% gelatin for at least 6 hours at room temperature and dried under sterile air. Test substances are diluted to appropriate concentrations in M199 supplemented with 0.25% bovine serum albumin (BSA), and 25 ul of the final dilution is placed in the lower chamber of the modified Boyden apparatus. Subconfluent, early passage (2-6) HUVEC or BMEC cultures are washed and trypsinized for the minimum time required to achieve cell detachment. After placing the filter between lower and upper chamber, $2.5 \times 10^5$ cells suspended in 50 ul M199 containing 1% FBS are seeded in the upper compartment. The apparatus is then incubated for 5 hours at 37° C. in a humidified chamber with 5% $CO_2$ to allow cell migration. After the incubation period, the filter is removed and the upper side of the filter with the non-migrated cells is scraped with a rubber policeman. The filters are fixed with methanol and stained with a Giemsa solution (Diff-Quick, Baxter, McGraw Park, Ill.). Migration is quantified by counting cells of three random high-power fields (40×) in each well, and all groups are performed in quadruplicate.

The studies described in this example tested activity of a polypeptide of the invention. However, one skilled in the art could easily modify the exemplified studies to test the activity of polynucleotides (e.g., gene therapy), agonists, and/or antagonists of the invention.

Example 40

Stimulation of Nitric Oxide Production by Endothelial Cells

Nitric oxide released by the vascular endothelium is believed to be a mediator of vascular endothelium relaxation. Thus, activity of a polypeptide of the invention can be assayed by determining nitric oxide production by endothelial cells in response to the polypeptide.

Nitric oxide is measured in 96-well plates of confluent microvascular endothelial cells after 24 hours starvation and a subsequent 4 hr exposure to various levels of a positive control (such as VEGF-1) and the polypeptide of the invention. Nitric oxide in the medium is determined by use of the Griess reagent to measure total nitrite after reduction of nitric oxide-derived nitrate by nitrate reductase. The effect of the polypeptide of the invention on nitric oxide release is examined on HUVEC.

Briefly, NO release from cultured HUVEC monolayer is measured with a NO-specific polarographic electrode connected to a NO meter (Iso-NO, World Precision Instruments Inc.) (1049). Calibration of the NO elements is performed according to the following equation:

The standard calibration curve is obtained by adding graded concentrations of $KNO_2$ (0, 5, 10, 25, 50, 100, 250, and 500 nmol/L) into the calibration solution containing $K_1$ and $H_2SO_4$. The specificity of the Iso-NO electrode to NO is previously determined by measurement of NO from authentic NO gas (1050). The culture medium is removed and HUVECs are washed twice with Dulbecco's phosphate buffered saline. The cells are then bathed in 5 ml of filtered Krebs-Henseleit solution in 6-well plates, and the cell plates are kept on a slide warmer (Lab Line Instruments Inc.) To maintain the temperature at 37° C. The NO sensor probe is inserted vertically into the wells, keeping the tip of the electrode 2 mm under the surface of the solution, before addition of the different conditions. S-nitroso acetyl penicillamin (SNAP) is used as a positive control. The amount of released NO is expressed as picomoles per $1 \times 10^6$ endothelial cells. All values reported are means of four to six measurements in each group (number of cell culture wells). See, Leak et al. *Biochem. and Biophys. Res. Comm.* 217:96-105 (1995).

The studies described in this example tested activity of polypeptides of the invention. However, one skilled in the art could easily modify the exemplified studies to test the activity of polynucleotides (e.g., gene therapy), agonists, and/or antagonists of the invention.

Example 41

Effect of Polypeptides of the Invention on Cord Formation in Angiogenesis

Another step in angiogenesis is cord formation, marked by differentiation of endothelial cells. This bioassay measures the ability of microvascular endothelial cells to form capillary-like structures (hollow structures) when cultured in vitro.

CADMEC (microvascular endothelial cells) are purchased from Cell Applications, Inc. as proliferating (passage 2) cells and are cultured in Cell Applications' CADMEC Growth Medium and used at passage 5. For the in vitro angiogenesis assay, the wells of a 48-well cell culture plate are coated with Cell Applications' Attachment Factor Medium (200 ml/well) for 30 min. at 37° C. CADMEC are seeded onto the coated wells at 7,500 cells/well and cultured overnight in Growth Medium. The Growth Medium is then replaced with 300 mg Cell Applications' Chord Formation Medium containing control buffer or a polypeptide of the invention (0.1 to 100 ng/ml) and the cells are cultured for an additional 48 hr. The numbers and lengths of the capillary-like chords are quantitated through use of the Boeckeler VIA-170 video image analyzer. All assays are done in triplicate.

Commercial (R&D) VEGF (50 ng/ml) is used as a positive control. b-estradiol (1 ng/ml) is used as a negative control. The appropriate buffer (without protein) is also utilized as a control.

The studies described in this example tested activity of a polypeptide of the invention. However, one skilled in the art could easily modify the exemplified studies to test the activity of polynucleotides (e.g., gene therapy), agonists, and/or antagonists of the invention.

Example 42

Angiogenic Effect on Chick Chorioallantoic Membrane

Chick chorioallantoic membrane (CAM) is a well-established system to examine angiogenesis. Blood vessel formation on CAM is easily visible and quantifiable. The ability of polypeptides of the invention to stimulate angiogenesis in CAM can be examined.

Fertilized eggs of the White Leghorn chick (*Gallus gallus*) and the Japanese qual (*Coturnix coturnix*) are incubated at 37.8° C. and 80% humidity. Differentiated CAM of 16-day-old chick and 13-day-old qual embryos is studied with the following methods.

On Day 4 of development, a window is made into the egg shell of chick eggs. The embryos are checked for normal development and the eggs sealed with cellotape. They are further incubated until Day 13. Thermanox coverslips (Nunc, Naperville, Ill.) are cut into disks of about 5 mm in diameter. Sterile and salt-free growth factors are dissolved in distilled water and about 3.3 mg/5 ml are pipetted on the disks. After air-drying, the inverted disks are applied on CAM. After 3 days, the specimens are fixed in 3% glutaraldehyde and 2% formaldehyde and rinsed in 0.12 M sodium cacodylate buffer. They are photographed with a stereo microscope [Wild M8] and embedded for semi- and ultrathin sectioning as described above. Controls are performed with carrier disks alone.

The studies described in this example tested activity of a polypeptide of the invention. However, one skilled in the art could easily modify the exemplified studies to test the activity of polynucleotides (e.g., gene therapy), agonists, and/or antagonists of the invention.

Example 43

Angiogenesis Assay Using a Matrigel Implant in Mouse

In vivo angiogenesis assay of a polypeptide of the invention measures the ability of an existing capillary network to form new vessels in an implanted capsule of murine extracellular matrix material (Matrigel). The protein is mixed with the liquid Matrigel at 4 degree C. and the mixture is then injected subcutaneously in mice where it solidifies. After 7 days, the solid "plug" of Matrigel is removed and examined for the presence of new blood vessels. Matrigel is purchased from Becton Dickinson Labware/Collaborative Biomedical Products.

When thawed at 4 degree C. the Matrigel material is a liquid. The Matrigel is mixed with a polypeptide of the invention at 150 ng/ml at 4 degrees C. and drawn into cold 3 ml syringes. Female C57B1/6 mice approximately 8 weeks old are injected with the mixture of Matrigel and experimental protein at 2 sites at the midventral aspect of the abdomen (0.5 ml/site). After 7 days, the mice are sacrificed by cervical dislocation, the Matrigel plugs are removed and cleaned (i.e., all clinging membranes and fibrous tissue is removed). Replicate whole plugs are fixed in neutral buffered 10% formaldehyde, embedded in paraffin and used to produce sections for histological examination after staining with Masson's Trichrome. Cross sections from 3 different regions of each plug are processed. Selected sections are stained for the presence of vWF. The positive control for this assay is bovine basic FGF (150 ng/ml). Matrigel alone is used to determine basal levels of angiogenesis.

The studies described in this example tested activity of a polypeptide of the invention. However, one skilled in the art could easily modify the exemplified studies to test the activity of polynucleotides (e.g., gene therapy), agonists, and/or antagonists of the invention.

Example 44

Rescue of Ischemia in Rabbit Lower Limb Model

To study the in vivo effects of polynucleotides and polypeptides of the invention on ischemia, a rabbit hindlimb ischemia model is created by surgical removal of one femoral arteries as described previously (Takeshita et al., *Am J. Pathol* 147:1649-1660 (1995)). The excision of the femoral artery results in retrograde propagation of thrombus and occlusion of the external iliac artery. Consequently, blood flow to the ischemic limb is dependent upon collateral vessels originating from the internal iliac artery (Takeshita et al. *Am J. Pathol* 147:1649-1660 (1995)). An interval of 10 days is allowed for post-operative recovery of rabbits and development of endogenous collateral vessels. At 10 day post-operatively (day 0), after performing a baseline angiogram, the internal iliac artery of the ischemic limb is transfected with 500 mg naked expression plasmid containing a polynucleotide of the invention by arterial gene transfer technology using a hydrogel-coated balloon catheter as described (Riessen et al. *Hum Gene Ther.* 4:749-758 (1993); Leclerc et al. *J. Clin. Invest.* 90: 936-944 (1992)). When a polypeptide of the invention is used in the treatment, a single bolus of 500 mg polypeptide of the invention or control is delivered into the internal iliac artery of the ischemic limb over a period of 1 min. through an infusion catheter. On day 30, various parameters are measured in these rabbits: (a) BP ratio—The blood pressure ratio of systolic pressure of the ischemic limb to that of normal limb; (b) Blood Flow and Flow Reserve—Resting FL: the blood flow during undilated condition and Max FL: the blood flow during fully dilated condition (also an indirect measure of the blood vessel amount) and Flow Reserve is reflected by the ratio of max FL: resting FL; (c) Angiographic Score—This is measured by the angiogram of collateral vessels. A score is determined by the percentage of circles in an overlaying grid that with crossing opacified arteries divided by the total number m the rabbit thigh; (d) Capillary density—The number of collateral capillaries determined in light microscopic sections taken from hindlimbs.

The studies described in this example tested activity of polynucleotides and polypeptides of the invention. However,

Example 45

Effect of Polypeptides of the Invention on Vasodilation

Since dilation of vascular endothelium is important in reducing blood pressure, the ability of polypeptides of the invention to affect the blood pressure in spontaneously hypertensive rats (SHR) is examined. Increasing doses (0, 10, 30, 100, 300, and 900 mg/kg) of the polypeptides of the invention are administered to 13-14 week old spontaneously hypertensive rats (SHR). Data are expressed as the mean+/−SEM. Statistical analysis are performed with a paired t-test and statistical significance is defined as $p<0.05$ vs. the response to buffer alone.

The studies described in this example tested activity of a polypeptide of the invention. However, one skilled in the art could easily modify the exemplified studies to test the activity of polynucleotides (e.g., gene therapy), agonists, and/or antagonists of the invention.

Example 46

Rat Ischemic Skin Flap Model

The evaluation parameters include skin blood flow, skin temperature, and factor VIII immunohistochemistry or endothelial alkaline phosphatase reaction. Expression of polypeptides of the invention, during the skin ischemia, is studied using in situ hybridization.

The study in this model is divided into three parts as follows:
 Ischemic skin
 Ischemic skin wounds
 Normal wounds The experimental protocol includes:

Raising a 3×4 cm, single pedicle full-thickness random skin flap (myocutaneous flap over the lower back of the animal).

An excisional wounding (4-6 mm in diameter) in the ischemic skin (skin-flap).

Topical treatment with a polypeptide of the invention of the excisional wounds (day 0, 1, 2, 3, 4 post-wounding) at the following various dosage ranges: 1 mg to 100 mg.

Harvesting the wound tissues at day 3, 5, 7, 10, 14 and 21 post-wounding for histological, immunohistochemical, and in situ studies.

The studies described in this example tested activity of a polypeptide of the invention. However, one skilled in the art could easily modify the exemplified studies to test the activity of polynucleotides (e.g., gene therapy), agonists, and/or antagonists of the invention.

Example 47

Peripheral Arterial Disease Model

Angiogenic therapy using a polypeptide of the invention is a novel therapeutic strategy to obtain restoration of blood flow around the ischemia in case of peripheral arterial diseases. The experimental protocol includes:

One side of the femoral artery is ligated to create ischemic muscle of the hindlimb, the other side of hindlimb serves as a control.

A polypeptide of the invention, in a dosage range of 20 mg-500 mg, is delivered intravenously and/or intramuscularly 3 times (perhaps more) per week for 2-3 weeks.

The ischemic muscle tissue is collected after ligation of the femoral artery at 1, 2, and 3 weeks for the analysis of expression of a polypeptide of the invention and histology. Biopsy is also performed on the other side of normal muscle of the contralateral hindlimb.

The studies described in this example tested activity of a polypeptide of the invention. However, one skilled in the art could easily modify the exemplified studies to test the activity of polynucleotides (e.g., gene therapy), agonists, and/or antagonists of the invention.

Example 48

Ischemic Myocardial Disease Model

A polypeptide of the invention is evaluated as a potent mitogen capable of stimulating the development of collateral vessels, and restructuring new vessels after coronary artery occlusion. Alteration of expression of the polypeptide is investigated in situ. The experimental protocol includes:

The heart is exposed through a left-side thoracotomy in the rat Immediately, the left coronary artery is occluded with a thin suture (6-0) and the thorax is closed.

A polypeptide of the invention, in a dosage range of 20 mg-500 mg, is delivered intravenously and/or intramuscularly 3 times (perhaps more) per week for 2-4 weeks.

Thirty days after the surgery, the heart is removed and cross-sectioned for morphometric and in situ analyzes.

The studies described in this example tested activity of a polypeptide of the invention. However, one skilled in the art could easily modify the exemplified studies to test the activity of polynucleotides (e.g., gene therapy), agonists, and/or antagonists of the invention.

Example 49

Rat Corneal Wound Healing Model

This animal model shows the effect of a polypeptide of the invention on neovascularization. The experimental protocol includes:

Making a 1-1.5 mm long incision from the center of cornea into the stromal layer. Inserting a spatula below the lip of the incision facing the outer corner of the eye. Making a pocket (its base is 1-1.5 mm form the edge of the eye). Positioning a pellet, containing 50 ng-5 ug of a polypeptide of the invention, within the pocket.

Treatment with a polypeptide of the invention can also be applied topically to the corneal wounds in a dosage range of 20 mg-500 mg (daily treatment for five days).

The studies described in this example tested activity of a polypeptide of the invention. However, one skilled in the art could easily modify the exemplified studies to test the activity of polynucleotides (e.g., gene therapy), agonists, and/or antagonists of the invention.

Example 50

Diabetic Mouse and Glucocorticoid-Impaired Wound Healing Models

Diabetic db+/db+ Mouse Model.

To demonstrate that a polypeptide of the invention accelerates the healing process, the genetically diabetic mouse model of wound healing is used. The full thickness wound healing model in the db+/db+ mouse is a well characterized, clinically relevant and reproducible model of impaired wound healing. Healing of the diabetic wound is dependent on formation of granulation tissue and re-epithelialization rather than contraction (Gartner, M. H. et al., *J. Surg. Res.* 52:389 (1992); Greenhalgh, D. G. et al., *Am. J. Pathol.* 136: 1235 (1990)).

The diabetic animals have many of the characteristic features observed in Type II diabetes mellitus. Homozygous (db+/db+) mice are obese in comparison to their normal heterozygous (db+/+m) littermates. Mutant diabetic (db+/db+) mice have a single autosomal recessive mutation on chromosome 4 (db+) (Coleman et al. *Proc. Natl. Acad. Sci. USA* 77:283-293 (1982)). Animals show polyphagia, polydipsia and polyuria. Mutant diabetic mice (db+/db+) have elevated blood glucose, increased or normal insulin levels, and suppressed cell-mediated immunity (Mandel et al., *J. Immunol.* 120:1375 (1978); Debray-Sachs, M. et al., *Clin. Exp. Immunol.* 51(1):1-7 (1983); Leiter et al., *Am. J. of Pathol.* 114:46-55 (1985)). Peripheral neuropathy, myocardial complications, and microvascular lesions, basement membrane thickening and glomerular filtration abnormalities have been described in these animals (Norido, F. et al., *Exp. Neurol.* 83(2):221-232 (1984); Robertson et al., *Diabetes* 29(1):60-67 (1980); Giacomelli et al., *Lab Invest.* 40(4):460-473 (1979); Coleman, D. L., *Diabetes* 31 (Suppl):1-6 (1982)). These homozygous diabetic mice develop hyperglycemia that is resistant to insulin analogous to human type II diabetes (Mandel et al., *J. Immunol.* 120:1375-1377 (1978)).

The characteristics observed in these animals suggests that healing in this model may be similar to the healing observed in human diabetes (Greenhalgh, et al., *Am. J. of Pathol.* 136: 1235-1246 (1990)).

Genetically diabetic female C57BL/KsJ (db+/db+) mice and their non-diabetic (db+/+m) heterozygous littermates are used in this study (Jackson Laboratories). The animals are purchased at 6 weeks of age and are 8 weeks old at the beginning of the study. Animals are individually housed and received food and water ad libitum. All manipulations are performed using aseptic techniques. The experiments are conducted according to the rules and guidelines of Human Genome Sciences, Inc. Institutional Animal Care and Use Committee and the Guidelines for the Care and Use of Laboratory Animals.

Wounding protocol is performed according to previously reported methods (Tsuboi, R. and Rifkin, D.B., *J. Exp. Med.* 172:245-251 (1990)). Briefly, on the day of wounding, animals are anesthetized with an intraperitoneal injection of Avertin (0.01 mg/mL), 2,2,2-tribromoethanol and 2-methyl-2-butanol dissolved in deionized water. The dorsal region of the animal is shaved and the skin washed with 70% ethanol solution and iodine. The surgical area is dried with sterile gauze prior to wounding. An 8 mm full-thickness wound is then created using a Keyes tissue punch. Immediately following wounding, the surrounding skin is gently stretched to eliminate wound expansion. The wounds are left open for the duration of the experiment. Application of the treatment is given topically for 5 consecutive days commencing on the day of wounding. Prior to treatment, wounds are gently cleansed with sterile saline and gauze sponges.

Wounds are visually examined and photographed at a fixed distance at the day of surgery and at two day intervals thereafter. Wound closure is determined by daily measurement on days 1-5 and on day 8. Wounds are measured horizontally and vertically using a calibrated Jameson caliper. Wounds are considered healed if granulation tissue is no longer visible and the wound is covered by a continuous epithelium.

A polypeptide of the invention is administered using at a range different doses, from 4 mg to 500 mg per wound per day for 8 days in vehicle. Vehicle control groups received 50 mL of vehicle solution.

Animals are euthanized on day 8 with an intraperitoneal injection of sodium pentobarbital (300 mg/kg). The wounds and surrounding skin are then harvested for histology and immunohistochemistry. Tissue specimens are placed in 10% neutral buffered formalin in tissue cassettes between biopsy sponges for further processing.

Three groups of 10 animals each (5 diabetic and 5 non-diabetic controls) are evaluated: 1) Vehicle placebo control, 2) untreated group, and 3) treated group.

Wound closure is analyzed by measuring the area in the vertical and horizontal axis and obtaining the total square area of the wound. Contraction is then estimated by establishing the differences between the initial wound area (day 0) and that of post treatment (day 8). The wound area on day 1 is 64 mm$^2$, the corresponding size of the dermal punch. Calculations are made using the following formula:

$$[\text{Open area on day 8}] - [\text{Open area on day 1}]/[\text{Open area on day 1}]$$

Specimens are fixed in 10% buffered formalin and paraffin embedded blocks are sectioned perpendicular to the wound surface (5 mm) and cut using a Reichert-Jung microtome. Routine hematoxylin-eosin (H&E) staining is performed on cross-sections of bisected wounds. Histologic examination of the wounds are used to assess whether the healing process and the morphologic appearance of the repaired skin is altered by treatment with a polypeptide of the invention. This assessment included verification of the presence of cell accumulation, inflammatory cells, capillaries, fibroblasts, re-epithelialization and epidermal maturity (Greenhalgh, D. G. et al., *Am. J. Pathol.* 136:1235 (1990)). A calibrated lens micrometer is used by a blinded observer.

Tissue sections are also stained immunohistochemically with a polyclonal rabbit anti-human keratin antibody using ABC Elite detection system. Human skin is used as a positive tissue control while non-immune IgG is used as a negative control. Keratinocyte growth is determined by evaluating the extent of reepithelialization of the wound using a calibrated lens micrometer.

Proliferating cell nuclear antigen/cyclin (PCNA) in skin specimens is demonstrated by using anti-PCNA:antibody (1:50) with an ABC Elite detection system. Human colon cancer can serve as a positive tissue control and human brain tissue can be used as a negative tissue control. Each specimen includes a section with omission of the primary antibody and substitution with non-immune mouse IgG. Ranking of these sections is based on the extent of proliferation on a scale of 0-8, the lower side of the scale reflecting slight proliferation to the higher side reflecting intense proliferation.

Experimental data are analyzed using an unpaired t test. A p value of <0.05 is considered significant.

Steroid Impaired Rat Model

The inhibition of wound healing by steroids has been well documented in various in vitro and in vivo systems (Wahl, Glucocorticoids and Wound healing. In: Anti-Inflammatory Steroid Action: Basic and Clinical Aspects. 280-302 (1989); Wahl et al., *J. Immunol.* 115: 476-481 (1975); Werb et al., *J. Exp. Med.* 147:1684-1694 (1978)). Glucocorticoids retard wound healing by inhibiting angiogenesis, decreasing vascular permeability (Ebert et al., *An. Intern. Med.* 37:701-705 (1952)), fibroblast proliferation, and collagen synthesis (Beck et al., *Growth Factors.* 5: 295-304 (1991); Haynes et al., *J. Clin. Invest.* 61: 703-797 (1978)) and producing a transient reduction of circulating monocytes (Haynes et al., *J. Clin. Invest.* 61: 703-797 (1978); Wahl, "Glucocorticoids and wound healing", In: Antiinflammatory Steroid Action: Basic and Clinical Aspects, Academic Press, New York, pp. 280-302 (1989)). The systemic administration of steroids to impaired wound healing is a well establish phenomenon in rats (Beck et al., *Growth Factors.* 5: 295-304 (1991); Haynes et al., *J. Clin. Invest.* 61: 703-797 (1978); Wahl, "Glucocorticoids and wound healing", In: Antiinflammatory Steroid Action Basic and Clinical Aspects, Academic Press, New York, pp. 280-302 (1989); Pierce et al., *Proc. Natl. Acad. Sci. USA* 86: 2229-2233 (1989)).

To demonstrate that a polypeptide of the invention can accelerate the healing process, the effects of multiple topical applications of the polypeptide on full thickness excisional skin wounds in rats in which healing has been impaired by the systemic administration of methylprednisolone is assessed.

Young adult male Sprague Dawley rats weighing 250-300 g (Charles River Laboratories) are used in this example. The animals are purchased at 8 weeks of age and are 9 weeks old at the beginning of the study. The healing response of rats is impaired by the systemic administration of methylprednisolone (17 mg/kg/rat intramuscularly) at the time of wounding. Animals are individually housed and received food and water ad libitum. All manipulations are performed using aseptic techniques. This study is conducted according to the rules and guidelines of Human Genome Sciences, Inc. Institutional Animal Care and Use Committee and the Guidelines for the Care and Use of Laboratory Animals.

The wounding protocol is followed according to section A, above. On the day of wounding, animals are anesthetized with an intramuscular injection of ketamine (50 mg/kg) and xylazine (5 mg/kg). The dorsal region of the animal is shaved and the skin washed with 70% ethanol and iodine solutions. The surgical area is dried with sterile gauze prior to wounding. An 8 mm full-thickness wound is created using a Keyes tissue punch. The wounds are left open for the duration of the experiment. Applications of the testing materials are given topically once a day for 7 consecutive days commencing on the day of wounding and subsequent to methylprednisolone administration. Prior to treatment, wounds are gently cleansed with sterile saline and gauze sponges.

Wounds are visually examined and photographed at a fixed distance at the day of wounding and at the end of treatment. Wound closure is determined by daily measurement on days 1-5 and on day 8. Wounds are measured horizontally and vertically using a calibrated Jameson caliper. Wounds are considered healed if granulation tissue is no longer visible and the wound is covered by a continuous epithelium.

The polypeptide of the invention is administered using at a range different doses, from 4 mg to 500 mg per wound per day for 8 days in vehicle. Vehicle control groups received 50 mL of vehicle solution.

Animals are euthanized on day 8 with an intraperitoneal injection of sodium pentobarbital (300 mg/kg). The wounds and surrounding skin are then harvested for histology. Tissue specimens are placed in 10% neutral buffered formalin in tissue cassettes between biopsy sponges for further processing.

Four groups of 10 animals each (5 with methylprednisolone and 5 without glucocorticoid) are evaluated: 1) Untreated group 2) Vehicle placebo control 3) treated groups.

Wound closure is analyzed by measuring the area in the vertical and horizontal axis and obtaining the total area of the wound. Closure is then estimated by establishing the differences between the initial wound area (day 0) and that of post treatment (day 8). The wound area on day 1 is 64 mm², the corresponding size of the dermal punch. Calculations are made using the following formula:

[Open area on day 8]−[Open area on day 1]/[Open area on day 1]

Specimens are fixed in 10% buffered formalin and paraffin embedded blocks are sectioned perpendicular to the wound surface (5 mm) and cut using an Olympus microtome. Routine hematoxylin-eosin (H&E) staining is performed on cross-sections of bisected wounds. Histologic examination of the wounds allows assessment of whether the healing process and the morphologic appearance of the repaired skin is improved by treatment with a polypeptide of the invention. A calibrated lens micrometer is used by a blinded observer to determine the distance of the wound gap.

Experimental data are analyzed using an unpaired t test. A p value of <0.05 is considered significant.

The studies described in this example tested activity of a polypeptide of the invention. However, one skilled in the art could easily modify the exemplified studies to test the activity of polynucleotides (e.g., gene therapy), agonists, and/or antagonists of the invention.

Example 51

Lymphadema Animal Model

The purpose of this experimental approach is to create an appropriate and consistent lymphedema model for testing the therapeutic effects of a polypeptide of the invention in lymphangiogenesis and re-establishment of the lymphatic circulatory system in the rat hind limb. Effectiveness is measured by swelling volume of the affected limb, quantification of the amount of lymphatic vasculature, total blood plasma protein, and histopathology. Acute lymphedema is observed for 7-10 days. Perhaps more importantly, the chronic progress of the edema is followed for up to 3-4 weeks.

Prior to beginning surgery, blood sample is drawn for protein concentration analysis. Male rats weighing approximately ~350 g are dosed with Pentobarbital. Subsequently, the right legs are shaved from knee to hip. The shaved area is swabbed with gauze soaked in 70% EtOH. Blood is drawn for serum total protein testing. Circumference and volumetric measurements are made prior to injecting dye into paws after marking 2 measurement levels (0.5 cm above heel, at mid-pt of dorsal paw). The intradermal dorsum of both right and left paws are injected with 0.05 ml of 1% Evan's Blue. Circumference and volumetric measurements are then made following injection of dye into paws.

Using the knee joint as a landmark, a mid-leg inguinal incision is made circumferentially allowing the femoral vessels to be located. Forceps and hemostats are used to dissect and separate the skin flaps. After locating the femoral vessels, the lymphatic vessel that runs along side and underneath the vessel(s) is located. The main lymphatic vessels in this area are then electrically coagulated suture ligated.

Using a microscope, muscles in back of the leg (near the semitendinosis and adductors) are bluntly dissected. The popliteal lymph node is then located. The 2 proximal and 2 distal lymphatic vessels and distal blood supply of the popliteal node are then and ligated by suturing. The popliteal lymph node, and any accompanying adipose tissue, is then removed by cutting connective tissues.

Care is taken to control any mild bleeding resulting from this procedure. After lymphatics are occluded, the skin flaps are sealed by using liquid skin (Vetbond) (AJ Buck). The separated skin edges are sealed to the underlying muscle tissue while leaving a gap of ~0.5 cm around the leg. Skin also may be anchored by suturing to underlying muscle when necessary.

To avoid infection, animals are housed individually with mesh (no bedding). Recovering animals are checked daily through the optimal edematous peak, which typically occurred by day 5-7. The plateau edematous peak are then observed. To evaluate the intensity of the lymphedema, the circumference and volumes of 2 designated places on each paw before operation and daily for 7 days are measured. The effect plasma proteins on lymphedema is determined and whether protein analysis is a useful testing perimeter is also investigated. The weights of both control and edematous limbs are evaluated at 2 places. Analysis is performed in a blind manner.

Circumference Measurements: Under brief gas anesthetic to prevent limb movement, a cloth tape is used to measure limb circumference. Measurements are done at the ankle bone and dorsal paw by 2 different people then those 2 readings are averaged. Readings are taken from both control and edematous limbs.

Volumetric Measurements: On the day of surgery, animals are anesthetized with Pentobarbital and are tested prior to surgery. For daily volumetrics animals are under brief halothane anesthetic (rapid immobilization and quick recovery), both legs are shaved and equally marked using waterproof marker on legs. Legs are first dipped in water, then dipped into instrument to each marked level then measured by Buxco edema software (Chen/Victor). Data is recorded by one person, while the other is dipping the limb to marked area.

Blood-plasma protein measurements: Blood is drawn, spun, and serum separated prior to surgery and then at conclusion for total protein and Ca2+ comparison.

Limb Weight Comparison: After drawing blood, the animal is prepared for tissue collection. The limbs are amputated using a quillitine, then both experimental and control legs are cut at the ligature and weighed. A second weighing is done as the tibio-cacaneal joint is disarticulated and the foot is weighed.

Histological Preparations: The transverse muscle located behind the knee (popliteal) area is dissected and arranged in a metal mold, filled with freezeGel, dipped into cold methylbutane, placed into labeled sample bags at −80EC until sectioning. Upon sectioning, the muscle is observed under fluorescent microscopy for lymphatics.

The studies described in this example tested activity of a polypeptide of the invention. However, one skilled in the art could easily modify the exemplified studies to test the activity of polynucleotides (e.g., gene therapy), agonists, and/or antagonists of the invention.

Example 52

Suppression of TNF Alpha-Induced Adhesion Molecule Expression by a Polypeptide of the Invention The recruitment of lymphocytes to areas of inflammation and angiogenesis involves specific receptor-ligand interactions between cell surface adhesion molecules (CAMs) on lymphocytes and the vascular endothelium. The adhesion process, in both normal and pathological settings, follows a multi-step cascade that involves intercellular adhesion molecule-1 (ICAM-1), vascular cell adhesion molecule-1 (VCAM-1), and endothelial leukocyte adhesion molecule-1 (E-selectin) expression on endothelial cells (EC). The expression of these molecules and others on the vascular endothelium determines the efficiency with which leukocytes may adhere to the local vasculature and extravasate into the local tissue during the development of an inflammatory response. The local concentration of cytokines and growth factor participate in the modulation of the expression of these CAMs.

Tumor necrosis factor alpha (TNF-a), a potent proinflammatory cytokine, is a stimulator of all three CAMs on endothelial cells and may be involved in a wide variety of inflammatory responses, often resulting in a pathological outcome.

The potential of a polypeptide of the invention to mediate a suppression of TNF-a induced CAM expression can be examined. A modified ELISA assay which uses ECs as a solid phase absorbent is employed to measure the amount of CAM expression on TNF-a treated ECs when co-stimulated with a member of the FGF family of proteins.

To perform the experiment, human umbilical vein endothelial cell (HUVEC) cultures are obtained from pooled cord harvests and maintained in growth medium (EGM-2; Clonetics, San Diego, Calif.) supplemented with 10% FCS and 1% penicillin/streptomycin in a 37 degree C. humidified incubator containing 5% $CO_2$. HUVECs are seeded in 96-well plates at concentrations of $1\times10^4$ cells/well in EGM medium at 37 degree C. for 18-24 hrs or until confluent. The monolayers are subsequently washed 3 times with a serum-free solution of RPMI-1640 supplemented with 100 U/ml penicillin and 100 mg/ml streptomycin, and treated with a given cytokine and/or growth factor(s) for 24 h at 37 degree C. Following incubation, the cells are then evaluated for CAM expression.

Human Umbilical Vein Endothelial cells (HUVECs) are grown in a standard 96 well plate to confluence. Growth medium is removed from the cells and replaced with 90 ul of 199 Medium (10% FBS). Samples for testing and positive or negative controls are added to the plate in triplicate (in 10 ul volumes). Plates are incubated at 37 degree C. for either 5 h (selectin and integrin expression) or 24 h (integrin expression only). Plates are aspirated to remove medium and 100 µl of 0.1% paraformaldehyde-PBS (with Ca++ and Mg++) is added to each well. Plates are held at 4° C. for 30 min.

Fixative is then removed from the wells and wells are washed 1× with PBS(+Ca,Mg)+0.5% BSA and drained. Do not allow the wells to dry. Add 10 µl of diluted primary antibody to the test and control wells. Anti-ICAM-1-Biotin, Anti-VCAM-1-Biotin and Anti-E-selectin-Biotin are used at a concentration of 10 µg/ml (1:10 dilution of 0.1 mg/ml stock antibody). Cells are incubated at 37° C. for 30 min. in a humidified environment. Wells are washed ×3 with PBS(+Ca, Mg)+0.5% BSA.

Then add 20 μl of diluted ExtrAvidin-Alkaline Phosphotase (1:5,000 dilution) to each well and incubated at 37° C. for 30 min. Wells are washed ×3 with PBS(+Ca,Mg)+0.5% BSA. 1 tablet of p-Nitrophenol Phosphate pNPP is dissolved in 5 ml of glycine buffer (pH 10.4). 100 μl of pNPP substrate in glycine buffer is added to each test well. Standard wells in triplicate are prepared from the working dilution of the ExtrAvidin-Alkaline Phosphotase in glycine buffer: 1:5,000 ($10^0$)>$10^{-0.5}$>$10^{-1}$>$10^{-1}$ 0.5 μl of each dilution is added to triplicate wells and the resulting AP content in each well is 5.50 ng, 1.74 ng, 0.55 ng, 0.18 ng. 100 μl of pNNP reagent must then be added to each of the standard wells. The plate must be incubated at 37° C. for 4 h. A volume of 50 μl of 3M NaOH is added to all wells. The results are quantified on a plate reader at 405 nm. The background subtraction option is used on blank wells filled with glycine buffer only. The template is set up to indicate the concentration of AP-conjugate in each standard well [5.50 ng; 1.74 ng; 0.55 ng; 0.18 ng]. Results are indicated as amount of bound AP-conjugate in each sample.

The studies described in this example tested activity of a polypeptide of the invention. However, one skilled in the art could easily modify the exemplified studies to test the activity of polynucleotides (e.g., gene therapy), agonists, and/or antagonists of the invention.

Example 53

Assay for the Stimulation of Bone Marrow CD34+ Cell Proliferation

This assay is based on the ability of human CD34+ to proliferate in the presence of hematopoietic growth factors and evaluates the ability of isolated polypeptides expressed in mammalian cells to stimulate proliferation of CD34+ cells.

It has been previously shown that most mature precursors will respond to only a single signal. More immature precursors require at least two signals to respond. Therefore, to test the effect of polypeptides on hematopoietic activity of a wide range of progenitor cells, the assay contains a given polypeptide in the presence or absence of other hematopoietic growth factors. Isolated cells are cultured for 5 days in the presence of Stem Cell Factor (SCF) in combination with tested sample. SCF alone has a very limited effect on the proliferation of bone marrow (BM) cells, acting in such conditions only as a "survival" factor. However, combined with any factor exhibiting stimulatory effect on these cells (e.g., IL-3), SCF will cause a synergistic effect. Therefore, if the tested polypeptide has a stimulatory effect on a hematopoietic progenitors, such activity can be easily detected. Since normal BM cells have a low level of cycling cells, it is likely that any inhibitory effect of a given polypeptide, or agonists or antagonists thereof, might not be detected. Accordingly, assays for an inhibitory effect on progenitors is preferably tested in cells that are first subjected to in vitro stimulation with SCF+IL+3, and then contacted with the compound that is being evaluated for inhibition of such induced proliferation.

Briefly, CD34+ cells are isolated using methods known in the art. The cells are thawed and resuspended in medium (QBSF 60 serum-free medium with 1% L-glutamine (500 ml) Quality Biological, Inc., Gaithersburg, Md. Cat# 160-204-101). After several gentle centrifugation steps at 200×g, cells are allowed to rest for one hour. The cell count is adjusted to $2.5 \times 10^5$ cells/ml. During this time, 100 μl of sterile water is added to the peripheral wells of a 96-well plate. The cytokines that can be tested with a given polypeptide in this assay is rhSCF (R&D Systems, Minneapolis, Minn., Cat# 255-SC) at 50 ng/ml alone and in combination with rhSCF and rhIL-3 (R&D Systems, Minneapolis, Minn., Cat# 203-ML) at 30 ng/ml. After one hour, 10 μl of prepared cytokines, 50 μl SID (supernatants at 1:2 dilution=50 μl) and 20 μl of diluted cells are added to the media which is already present in the wells to allow for a final total volume of 100 μl. The plates are then placed in a 37° C./5% $CO_2$ incubator for five days.

Eighteen hours before the assay is harvested, 0.5 μCi/well of [3H] Thymidine is added in a 10 μl volume to each well to determine the proliferation rate. The experiment is terminated by harvesting the cells from each 96-well plate to a filtermat using the Tomtec Harvester 96. After harvesting, the filtermats are dried, trimmed and placed into OmniFilter assemblies consisting of one OmniFilter plate and one OmniFilter Tray. 60 μl Microscint is added to each well and the plate sealed with TopSeal-A press-on sealing film A bar code 15 sticker is affixed to the first plate for counting. The sealed plates is then loaded and the level of radioactivity determined via the Packard Top Count and the printed data collected for analysis. The level of radioactivity reflects the amount of cell proliferation.

The studies described in this example test the activity of a given polypeptide to stimulate bone marrow CD34+ cell proliferation. One skilled in the art could easily modify the exemplified studies to test the activity of polynucleotides (e.g., gene therapy), antibodies, agonists, and/or antagonists and fragments and variants thereof. As a nonlimiting example, potential antagonists tested in this assay would be expected to inhibit cell proliferation in the presence of cytokines and/or to increase the inhibition of cell proliferation in the presence of cytokines and a given polypeptide. In contrast, potential agonists tested in this assay would be expected to enhance cell proliferation and/or to decrease the inhibition of cell proliferation in the presence of cytokines and a given polypeptide.

The ability of a gene to stimulate the proliferation of bone marrow CD34+ cells indicates that polynucleotides and polypeptides corresponding to the gene are useful for the diagnosis and treatment of disorders affecting the immune system and hematopoiesis. Representative uses are described in the "Immune Activity" and "Infectious Disease" sections above, and elsewhere herein.

Example 54

Assay for Extracellular Matrix Enhanced Cell Response (EMECR)

The objective of the Extracellular Matrix Enhanced Cell Response (EMECR) assay is to identify gene products (e.g., isolated polypeptides) that act on the hematopoietic stem cells in the context of the extracellular matrix (ECM) induced signal.

Cells respond to the regulatory factors in the context of signal(s) received from the surrounding microenvironment. For example, fibroblasts, and endothelial and epithelial stem cells fail to replicate in the absence of signals from the ECM. Hematopoietic stem cells can undergo self-renewal in the bone marrow, but not in in vitro suspension culture. The ability of stem cells to undergo self-renewal in vitro is dependent upon their interaction with the stromal cells and the ECM protein fibronectin (fn). Adhesion of cells to fn is mediated by the $a_5.\beta_1$ and $a_4.\beta_1$ integrin receptors, which are expressed by human and mouse hematopoietic stem cells. The factor(s) which integrate with the ECM environment and responsible for stimulating stem cell self-renewal has not yet been identified. Discovery of such factors should be of great interest in gene therapy and bone marrow transplant applications Briefly, polystyrene, non tissue culture treated, 96-well plates are coated with fn fragment at a coating concentration of 0.2 μg/cm². Mouse bone marrow cells are plated (1,000 cells/well) in 0.2 ml of serum-free medium. Cells cultured in the presence of IL-3 (5 ng/ml)+SCF (50 ng/ml) would serve as the positive control, conditions under which little self-renewal but pronounced differentiation of the stem cells is to be expected. Gene products are tested with appropriate negative controls in the presence and absence of SCF (5.0 ng/ml), where test factor supernates represent 10% of the total assay volume. The plated cells are then allowed to grow by incubating in a low oxygen environment (5% $CO_2$, 7% $O_2$, and 88% $N_2$) tissue culture incubator for 7 days. The number of proliferating cells within the wells is then quantitated by measuring thymidine incorporation into cellular DNA. Verification of the positive hits in the assay will require phenotypic characterization of the cells, which can be accomplished by scaling up of the culture system and using appropriate antibody reagents against cell surface antigens and FACScan.

One skilled in the art could easily modify the exemplified studies to test the activity of polynucleotides (e.g., gene therapy), antibodies, agonists, and/or antagonists and fragments and variants thereof.

If a particular gene product is found to be a stimulator of hematopoietic progenitors, polynucleotides and polypeptides corresponding to the gene may be useful for the diagnosis and treatment of disorders affecting the immune system and hematopoiesis. Representative uses are described in the "Immune Activity" and "Infectious Disease" sections above, and elsewhere herein. The gene product may also be useful in the expansion of stem cells and committed progenitors of various blood lineages, and in the differentiation and/or proliferation of various cell types.

Additionally, the polynucleotides and/or polypeptides of the gene of interest and/or agonists and/or antagonists thereof, may also be employed to inhibit the proliferation and differentiation of hematopoietic cells and therefore may be employed to protect bone marrow stem cells from chemotherapeutic agents during chemotherapy. This antiproliferative effect may allow administration of higher doses of chemotherapeutic agents and, therefore, more effective chemotherapeutic treatment.

Moreover, polynucleotides and polypeptides corresponding to the gene of interest may also be useful for the treatment and diagnosis of hematopoietic related disorders such as, for example, anemia, pancytopenia, leukopenia, thrombocytopenia or leukemia since stromal cells are important in the production of cells of hematopoietic lineages. The uses include bone marrow cell ex-vivo culture, bone marrow transplantation, bone marrow reconstitution, radiotherapy or chemotherapy of neoplasia.

Example 55

Human Dermal Fibroblast and Aortic Smooth Muscle Cell Proliferation

The polypeptide of interest is added to cultures of normal human dermal fibroblasts (NHDF) and human aortic smooth muscle cells (AoSMC) and two co-assays are performed with each sample. The first assay examines the effect of the polypeptide of interest on the proliferation of normal human dermal fibroblasts (NHDF) or aortic smooth muscle cells (AoSMC). Aberrant growth of fibroblasts or smooth muscle cells is a part of several pathological processes, including fibrosis, and restenosis. The second assay examines IL6 production by both NHDF and SMC. IL6 production is an indication of functional activation. Activated cells will have increased production of a number of cytokines and other factors, which can result in a proinflammatory or immunomodulatory outcome. Assays are run with and without co-TNFα stimulation, in order to check for costimulatory or inhibitory activity.

Briefly, on day 1, 96-well black plates are set up with 1000 cells/well (NHDF) or 2000 cells/well (AoSMC) in 100 μl culture media. NHDF culture media contains: Clonetics FB basal media, 1 mg/ml hFGF, 5 mg/ml insulin, 50 mg/ml gentamycin, 2% FBS, while AoSMC culture media contains Clonetics SM basal media, 0.5 μg/ml hEGF, 5 mg/ml insulin, 1 μg/ml hFGF, 50 mg/ml gentamycin, 50 μg/ml Amphotericin B, 5% FBS. After incubation @ 37° C. for at least 4-5 hours culture media is aspirated and replaced with growth arrest media. Growth arrest media for NHDF contains fibroblast basal media, 50 mg/ml gentamycin, 2% FBS, while growth arrest media for AoSMC contains SM basal media, 50 mg/ml gentamycin, 50 μg/ml Amphotericin B, 0.4% FBS. Incubate at 37 C until day 2.

On day 2, serial dilutions and templates of the polypeptide of interest are designed which should always include media controls and known-protein controls. For both stimulation and inhibition experiments, proteins are diluted in growth arrest media. For inhibition experiments, TNFα is added to a final concentration of 2 ng/ml (NHDF) or 5 ng/ml (AoSMC). Then add 1/3 vol media containing controls or supernatants and incubate at 37 C/5% $CO_2$ until day 5.

Transfer 60 μl from each well to another labeled 96-well plate, cover with a plate-sealer, and store at 4C until Day 6 (for IL6 ELISA). To the remaining 100 μl in the cell culture plate, aseptically add Alamar Blue in an amount equal to 10% of the culture volume (100. Return plates to incubator for 3 to 4 hours. Then measure fluorescence with excitation at 530 nm and emission at 590 nm using the CytoFluor. This yields the growth stimulation/inhibition data.

On day 5, the IL6 ELISA is performed by coating a 96 well plate with 50-100 ul/well of Anti-Human IL6 Monoclonal antibody diluted in PBS, pH 7.4, incubate ON at room temperature.

On day 6, empty the plates into the sink and blot on paper towels. Prepare Assay Buffer containing PBS with 4% BSA. Block the plates with 200 Owen of Pierce Super Block blocking buffer in PBS for 1-2 hr and then wash plates with wash buffer (PBS, 0.05% Tween-20). Blot plates on paper towels. Then add 50 μl/well of diluted Anti-Human IL-6 Monoclonal, Biotin-labeled antibody at 0.50 mg/ml. Make dilutions of IL-6 stock in media (30, 10, 3, 1, 0.3, 0 ng/ml). Add duplicate samples to top row of plate. Cover the plates and incubate for 2 hours at RT on shaker.

Wash plates with wash buffer and blot on paper towels. Dilute EU-labeled Streptavidin 1:1000 in Assay buffer, and add 100 μl/well. Cover the plate and incubate 1 h at RT. Wash plates with wash buffer. Blot on paper towels.

Add 100 μl/well of Enhancement Solution. Shake for 5 minutes. Read the plate on the Wallac DELFIA Fluorometer. Readings from triplicate samples in each assay were tabulated and averaged.

A positive result in this assay suggests AoSMC cell proliferation and that the gene product of interest may be involved in dermal fibroblast proliferation and/or smooth muscle cell proliferation. A positive result also suggests many potential uses of polypeptides, polynucleotides, agonists and/or antagonists of the gene/gene product of interest. For example, inflammation and immune responses, wound healing, and angiogenesis, as detailed throughout this specification. Particularly, polypeptides of the gene product and polynucleotides of the gene may be used in wound healing and dermal regeneration, as well as the promotion of vasculargenesis, both of the blood vessels and lymphatics. The growth of vessels can be used in the treatment of, for example, cardiovascular diseases. Additionally, antagonists of polypeptides of the gene product and polynucleotides of the gene may be useful in treating diseases, disorders, and/or conditions which involve angiogenesis by acting as an anti-vascular (e.g., anti-angiogenesis). These diseases, disorders, and/or conditions are known in the art and/or are described herein, such as, for example, malignancies, solid tumors, benign tumors, for example hemangiomas, acoustic neuromas, neurofibromas, trachomas, and pyogenic granulomas; artheroscleric plaques; ocular angiogenic diseases, for example, diabetic retinopathy, retinopathy of prematurity, macular degeneration, corneal graft rejection, neovascular glaucoma, retrolental fibroplasia, rubeosis, retinoblastoma, uvietis and Pterygia (abnormal blood vessel growth) of the eye; rheumatoid arthritis; psoriasis; delayed wound healing; endometriosis; vasculogenesis; granulations; hypertrophic scars (keloids); nonunion fractures; scleroderma; trachoma; vascular adhesions; myocardial angiogenesis; coronary collaterals; cerebral collaterals; arteriovenous malformations; ischemic limb angiogenesis; Osler-Webber Syndrome; plaque neovascularization; telangiectasia; hemophiliac joints; angiofibroma; fibromuscular dysplasia; wound granulation; Crohn's disease; and atherosclerosis. Moreover, antagonists of polypeptides of the gene product and polynucleotides of the gene may be useful in treating anti-hyperproliferative diseases and/or anti-inflammatory known in the art and/or described herein.

One skilled in the art could easily modify the exemplified studies to test the activity of polynucleotides (e.g., gene therapy), antibodies, agonists, and/or antagonists and fragments and variants thereof.

Example 56

Cellular Adhesion Molecule (CAM) Expression on Endothelial Cells

The recruitment of lymphocytes to areas of inflammation and angiogenesis involves specific receptor-ligand interactions between cell surface adhesion molecules (CAMs) on lymphocytes and the vascular endothelium. The adhesion process, in both normal and pathological settings, follows a multi-step cascade that involves intercellular adhesion molecule-1 (ICAM-1), vascular cell adhesion molecule-1 (VCAM-1), and endothelial leukocyte adhesion molecule-1 (E-selectin) expression on endothelial cells (EC). The expression of these molecules and others on the vascular endothelium determines the efficiency with which leukocytes may adhere to the local vasculature and extravasate into the local tissue during the development of an inflammatory response. The local concentration of cytokines and growth factor participate in the modulation of the expression of these CAMs.

Briefly, endothelial cells (e.g., Human Umbilical Vein Endothelial cells (HUVECs)) are grown in a standard 96 well plate to confluence, growth medium is removed from the cells and replaced with 100 µl of 199 Medium (10% fetal bovine serum (FBS)). Samples for testing and positive or negative controls are added to the plate in triplicate (in 10 µl volumes). Plates are then incubated at 37° C. for either 5 h (selectin and integrin expression) or 24 h (integrin expression only). Plates are aspirated to remove medium and 100 µl of 0.1% paraformaldehyde-PBS(with Ca++ and Mg++) is added to each well. Plates are held at 4° C. for 30 min. Fixative is removed from the wells and wells are washed 1× with PBS(+Ca,Mg)+0.5% BSA and drained. 10 µl of diluted primary antibody is added to the test and control wells. Anti-ICAM-1-Biotin, Anti-VCAM-1-Biotin and Anti-E-selectin-Biotin are used at a concentration of 10 µg/ml (1:10 dilution of 0.1 mg/ml stock antibody). Cells are incubated at 37° C. for 30 min. in a humidified environment. Wells are washed three times with PBS(+Ca,Mg)+0.5% BSA. 20 µl of diluted ExtrAvidin-Alkaline Phosphotase (1:5,000 dilution, referred to herein as the working dilution) are added to each well and incubated at 37° C. for 30 min. Wells are washed three times with PBS(+Ca, Mg)+0.5% BSA. Dissolve 1 tablet of p-Nitrophenol Phosphate pNPP per 5 ml of glycine buffer (pH 10.4). 100 µl of pNPP substrate in glycine buffer is added to each test well. Standard wells in triplicate are prepared from the working dilution of the ExtrAvidin-Alkaline Phosphotase in glycine buffer: $1:5,000 (10^0) > 10^{-0.5} > 10^{-1} > 10^{-1.5}$ 0.5 µl of each dilution is added to triplicate wells and the resulting AP content in each well is 5.50 ng, 1.74 ng, 0.55 ng, 0.18 ng. 100 µl of pNNP reagent is then added to each of the standard wells. The plate is incubated at 37° C. for 4 h. A volume of 50 µl of 3M NaOH is added to all wells. The plate is read on a plate reader at 405 nm using the background subtraction option on blank wells filled with glycine buffer only. Additionally, the template is set up to indicate the concentration of AP-conjugate in each standard well [5.50 ng; 1.74 ng; 0.55 ng; 0.18 ng]. Results are indicated as amount of bound AP-conjugate in each sample.

Example 57

Alamar Blue Endothelial Cells Proliferation Assay

This assay may be used to quantitatively determine protein mediated inhibition of bFGF-induced proliferation of Bovine Lymphatic Endothelial Cells (LECs), Bovine Aortic Endothelial Cells (BAECs) or Human Microvascular Uterine Myometrial Cells (UTMECs). This assay incorporates a fluorometric growth indicator based on detection of metabolic activity. A standard Alamar Blue Proliferation Assay is prepared in EGM-2MV with 10 ng/ml of bFGF added as a source of endothelial cell stimulation. This assay may be used with a variety of endothelial cells with slight changes in growth medium and cell concentration. Dilutions of the protein batches to be tested are diluted as appropriate. Serum-free medium (GIBCO SFM) without bFGF is used as a non-stimulated control and Angiostatin or TSP-1 are included as a known inhibitory controls.

Briefly, LEC, BAECs or UTMECs are seeded in growth media at a density of 5000 to 2000 cells/well in a 96 well plate and placed at 37-C overnight. After the overnight incubation of the cells, the growth media is removed and replaced with GIBCO EC-SFM. The cells are treated with the appropriate dilutions of the protein of interest or control protein sample(s) (prepared in SFM) in triplicate wells with additional bFGF to a concentration of 10 ng/ml. Once the cells have been treated with the samples, the plate(s) is/are placed back in the 37° C. incubator for three days. After three days 10 ml of stock alamar blue (Biosource Cat# DAL1100) is added to each well and the plate(s) is/are placed back in the 37° C. incubator for four hours. The plate(s) are then read at 530 nm excitation and 590 nm emission using the CytoFluor fluorescence reader. Direct output is recorded in relative fluorescence units.

Alamar blue is an oxidation-reduction indicator that both fluoresces and changes color in response to chemical reduction of growth medium resulting from cell growth. As cells grow in culture, innate metabolic activity results in a chemical reduction of the immediate surrounding environment. Reduction related to growth causes the indicator to change from oxidized (non-fluorescent blue) form to reduced (fluorescent red) form. i.e. stimulated proliferation will produce a stronger signal and inhibited proliferation will produce a weaker signal and the total signal is proportional to the total number of cells as well as their metabolic activity. The background level of activity is observed with the starvation medium alone. This is compared to the output observed from the positive control samples (bFGF in growth medium) and protein dilutions.

Example 58

Detection of Inhibition of a Mixed Lymphocyte Reaction

This assay can be used to detect and evaluate inhibition of a Mixed Lymphocyte Reaction (MLR) by gene products (e.g., isolated polypeptides) Inhibition of a MLR may be due to a direct effect on cell proliferation and viability, modulation of costimulatory molecules on interacting cells, modulation of adhesiveness between lymphocytes and accessory cells, or modulation of cytokine production by accessory cells. Multiple cells may be targeted by these polypeptides since the peripheral blood mononuclear fraction used in this assay includes T, B and natural killer lymphocytes, as well as monocytes and dendritic cells.

Polypeptides of interest found to inhibit the MLR may find application in diseases associated with lymphocyte and monocyte activation or proliferation. These include, but are not limited to, diseases such as asthma, arthritis, diabetes, inflammatory skin conditions, psoriasis, eczema, systemic lupus erythematosus, multiple sclerosis, glomerulonephritis, inflammatory bowel disease, crohn's disease, ulcerative colitis, arteriosclerosis, cirrhosis, graft vs. host disease, host vs. graft disease, hepatitis, leukemia and lymphoma.

Briefly, PBMCs from human donors are purified by density gradient centrifugation using Lymphocyte Separation Medium (LSM®, density 1.0770 g/ml, Organon Teknika Corporation, West Chester, Pa.). PBMCs from two donors are adjusted to $2 \times 10^6$ cells/ml in RPMI-1640 (Life Technologies, Grand Island, N.Y.) supplemented with 10% FCS and 2 mM glutamine. PBMCs from a third donor is adjusted to $2 \times 10^5$ cells/ml. Fifty microliters of PBMCs from each donor is added to wells of a 96-well round bottom microtiter plate.

Dilutions of test materials (50 μl) is added in triplicate to microtiter wells. Test samples (of the protein of interest) are added for final dilution of 1:4; rhuIL-2 (R&D Systems, Minneapolis, Minn., catalog number 202-IL) is added to a final concentration of 1 μg/ml; anti-CD4 mAb (R&D Systems, clone 34930.11, catalog number MAB379) is added to a final concentration of 10 μg/ml. Cells are cultured for 7-8 days at 37° C. in 5% $CO_2$, and 1 μC of [$^3$H] thymidine is added to wells for the last 16 hrs of culture. Cells are harvested and thymidine incorporation determined using a Packard Top-Count. Data is expressed as the mean and standard deviation of triplicate determinations.

Samples of the protein of interest are screened in separate experiments and compared to the negative control treatment, anti-CD4 mAb, which inhibits proliferation of lymphocytes and the positive control treatment, IL-2 (either as recombinant material or supernatant), which enhances proliferation of lymphocytes.

One skilled in the art could easily modify the exemplified studies to test the activity of polynucleotides (e.g., gene therapy), antibodies, agonists, and/or antagonists and fragments and variants thereof.

It will be clear that the invention may be practiced otherwise than as particularly described in the foregoing description and examples. Numerous modifications and variations of the present invention are possible in light of the above teachings and, therefore, are within the scope of the appended claims.

The entire disclosure of each document cited (including patents, patent applications, journal articles, abstracts, laboratory manuals, books, or other disclosures) in the Background of the Invention, Detailed Description, and Examples is hereby incorporated herein by reference. Further, the hard copy of the sequence listing submitted herewith and the corresponding computer readable form are both incorporated herein by reference in their entireties. Additionally, the contents of U.S. patent application Ser. Nos. 10/702,636, filed on Jan. 18, 2002 and 09/461,325, filed Dec. 14, 1999; of International Application No. PCT/US99/13418, filed Jun. 15, 1999; and of U.S. Provisional Application Ser. Nos. 60/263,230, filed Jan. 23, 2001, 60/263,681, filed Jan. 24, 2001, 60/089,507, 60/089,508, 60/089,509, 60/089,510, each of which was filed on Jun. 16, 1998, and 60/090,112 and 60/090,113, each of which was filed on Jun. 22, 1998 are all hereby incorporated by reference in their entireties.

TABLE 6

| Res | Position | I | II | III | IV | V | VI | VII | VIII | IX | X | XI | XII | XIII | XIV |
|---|---|---|---|---|---|---|---|---|---|---|---|---|---|---|---|
| Met | 1 | A | A | . | . | . | . | . | 0.61 | −0.60 | . | . | . | 0.75 | 1.47 |
| Lys | 2 | A | A | . | . | . | . | . | 0.41 | −0.64 | . | . | . | 0.96 | 1.54 |
| Arg | 3 | . | A | B | . | . | . | . | 0.46 | −0.57 | * | . | . | 1.17 | 1.22 |
| Ala | 4 | A | A | . | . | . | . | . | 0.50 | −0.57 | * | . | . | 1.38 | 1.22 |
| Ser | 5 | A | . | . | . | . | T | . | 0.59 | −0.76 | * | . | F | 1.99 | 0.60 |
| Ala | 6 | . | . | . | . | . | T | C | 1.30 | −0.37 | * | . | F | 2.10 | 0.41 |
| Gly | 7 | . | . | . | . | . | T | C | 0.44 | −0.37 | * | . | F | 1.89 | 0.80 |
| Gly | 8 | . | . | . | . | . | T | C | −0.48 | −0.19 | * | * | F | 1.68 | 0.49 |
| Ser | 9 | . | A | . | . | . | . | C | −0.48 | 0.11 | . | . | F | 0.47 | 0.40 |
| Arg | 10 | . | A | B | . | . | . | . | −0.47 | 0.11 | * | . | F | 0.06 | 0.41 |
| Leu | 11 | . | A | B | . | . | . | . | −0.73 | 0.60 | * | . | . | −0.60 | 0.43 |
| Leu | 12 | . | A | B | . | . | . | . | −1.20 | 0.81 | * | . | . | −0.60 | 0.24 |
| Ala | 13 | . | A | B | . | . | . | . | −1.14 | 1.11 | * | . | . | −0.60 | 0.10 |
| Trp | 14 | . | A | B | . | . | . | . | −1.66 | 2.03 | . | * | . | −0.60 | 0.13 |
| Val | 15 | . | A | B | . | . | . | . | −1.77 | 2.03 | . | * | . | −0.60 | 0.13 |
| Leu | 16 | A | A | . | . | . | . | . | −1.54 | 1.74 | . | . | . | −0.60 | 0.22 |
| Trp | 17 | A | A | . | . | . | . | . | −1.02 | 1.74 | . | . | . | −0.60 | 0.21 |
| Leu | 18 | A | A | . | . | . | . | . | −0.43 | 1.74 | . | . | . | −0.60 | 0.30 |
| Gln | 19 | A | A | . | . | . | . | . | −1.00 | 1.50 | . | . | . | −0.60 | 0.63 |
| Ala | 20 | . | A | . | . | T | . | . | −0.73 | 1.46 | . | . | . | −0.20 | 0.45 |

TABLE 6-continued

| Res | Position | I | II | III | IV | V | VI | VII | VIII | IX | X | XI | XII | XIII | XIV |
|---|---|---|---|---|---|---|---|---|---|---|---|---|---|---|---|
| Trp | 21 | . | A | . | . | T | . | . | −0.51 | 1.04 | . | . | . | −0.20 | 0.55 |
| Gln | 22 | . | A | B | . | . | . | . | −0.43 | 0.86 | . | . | . | −0.60 | 0.32 |
| Val | 23 | . | A | B | . | . | . | . | −0.29 | 0.89 | . | . | . | −0.60 | 0.49 |
| Ala | 24 | . | A | B | . | . | . | . | −0.50 | 0.96 | . | . | . | −0.60 | 0.25 |
| Ala | 25 | . | A | B | . | . | . | . | −0.26 | 0.47 | . | . | . | −0.60 | 0.22 |
| Pro | 26 | . | A | . | . | . | T | . | . | −0.56 | 0.50 | . | * | . | −0.20 | 0.30 |
| Cys | 27 | . | . | . | . | . | T | T | . | −1.22 | 0.36 | . | . | . | 0.50 | 0.30 |
| Pro | 28 | . | . | . | . | . | T | T | . | −1.22 | 0.43 | . | . | . | 0.20 | 0.16 |
| Gly | 29 | . | . | . | . | . | T | T | . | −1.30 | 0.57 | . | . | . | 0.20 | 0.08 |
| Ala | 30 | . | . | B | . | . | . | T | . | −0.96 | 0.71 | . | . | . | −0.20 | 0.08 |
| Cys | 31 | . | . | B | . | . | . | . | . | −0.74 | 0.90 | . | . | . | −0.40 | 0.08 |
| Val | 32 | . | . | B | . | . | . | . | . | −0.08 | 0.87 | . | . | . | −0.40 | 0.12 |
| Cys | 33 | . | . | B | . | . | . | T | . | −0.08 | 0.44 | . | . | . | −0.20 | 0.21 |
| Tyr | 34 | . | . | B | . | . | . | T | . | 0.31 | 0.37 | . | . | . | 0.36 | 0.62 |
| Asn | 35 | . | . | B | . | . | . | T | . | 0.04 | −0.20 | . | . | F | 1.52 | 1.66 |
| Glu | 36 | . | . | B | . | . | . | T | . | 0.40 | −0.20 | . | . | F | 1.78 | 2.30 |
| Pro | 37 | . | . | . | B | T | . | . | . | 0.94 | −0.29 | . | . | F | 2.04 | 2.11 |
| Lys | 38 | . | . | . | B | T | . | . | . | 1.31 | −0.56 | . | * | F | 2.60 | 1.90 |
| Val | 39 | . | . | . | B | T | . | . | . | 0.89 | −0.57 | . | * | F | 2.34 | 1.47 |
| Thr | 40 | . | . | B | B | . | . | . | . | 0.68 | 0.00 | . | * | F | 0.63 | 0.51 |
| Thr | 41 | . | . | B | B | . | . | . | . | 0.68 | 0.00 | . | * | F | 0.37 | 0.39 |
| Ser | 42 | . | . | B | B | . | . | . | . | 0.89 | 0.40 | * | * | F | −0.19 | 0.92 |
| Cys | 43 | . | . | B | . | . | . | T | . | 0.50 | 0.16 | * | * | F | 0.40 | 1.10 |
| Pro | 44 | . | . | . | . | T | T | . | . | 0.54 | 0.10 | . | . | F | 0.65 | 0.76 |
| Gln | 45 | . | . | . | . | T | T | . | . | 0.86 | 0.30 | . | . | F | 0.65 | 0.47 |
| Gln | 46 | . | . | B | . | . | . | T | . | 0.58 | 0.31 | * | . | F | 0.40 | 1.50 |
| Gly | 47 | . | . | A | B | . | . | . | . | 0.02 | 0.24 | * | . | F | −0.15 | 0.98 |
| Leu | 48 | . | A | B | B | . | . | . | . | 0.48 | 0.46 | . | . | . | −0.60 | 0.42 |
| Gln | 49 | . | A | B | B | . | . | . | . | −0.17 | 0.49 | . | . | . | −0.60 | 0.38 |
| Ala | 50 | . | A | B | B | . | . | . | . | −0.51 | 0.73 | * | . | . | −0.60 | 0.28 |
| Val | 51 | . | A | B | B | . | . | . | . | −1.40 | 0.73 | * | . | . | −0.60 | 0.34 |
| Pro | 52 | . | . | B | B | . | . | . | . | −1.27 | 0.73 | . | . | . | −0.60 | 0.14 |
| Val | 53 | . | . | B | B | . | . | . | . | −1.04 | 0.76 | . | . | . | −0.60 | 0.21 |
| Gly | 54 | . | . | B | . | . | . | . | . | −1.63 | 0.76 | . | . | . | −0.40 | 0.29 |
| Ile | 55 | . | . | B | . | . | . | . | . | −1.34 | 0.61 | . | . | . | −0.40 | 0.19 |
| Pro | 56 | . | . | B | . | . | . | . | . | −0.49 | 0.57 | . | * | . | −0.40 | 0.34 |
| Ala | 57 | A | . | . | . | . | . | . | . | −0.17 | 0.33 | . | * | . | −0.10 | 0.59 |
| Ala | 58 | A | . | . | . | . | . | . | . | −0.20 | −0.10 | * | . | . | 0.65 | 1.64 |
| Ser | 59 | A | . | . | . | B | . | . | . | −0.56 | −0.10 | * | * | F | 0.45 | 0.75 |
| Gln | 60 | . | . | B | B | . | . | . | . | −0.48 | 0.26 | * | * | F | −0.15 | 0.64 |
| Arg | 61 | . | . | B | B | . | . | . | . | −0.30 | 0.44 | . | * | F | −0.45 | 0.52 |
| Ile | 62 | . | . | B | B | . | . | . | . | −0.06 | 0.44 | * | * | . | −0.60 | 0.53 |
| Phe | 63 | . | . | B | B | . | . | . | . | 0.53 | 0.49 | * | * | . | −0.60 | 0.30 |
| Leu | 64 | . | . | B | B | . | . | . | . | 0.94 | 0.49 | * | * | . | −0.60 | 0.25 |
| His | 65 | . | . | . | . | T | T | . | . | 0.06 | 0.49 | * | * | . | 0.26 | 0.69 |
| Gly | 66 | . | . | . | . | T | T | . | . | −0.36 | 0.49 | * | * | F | 0.47 | 0.56 |
| Asn | 67 | . | . | . | . | T | T | . | . | 0.50 | 0.09 | * | . | F | 0.83 | 0.91 |
| Arg | 68 | . | . | . | . | T | T | . | . | 0.34 | −0.10 | . | . | F | 1.49 | 0.91 |
| Ile | 69 | . | . | . | . | T | . | . | . | 0.94 | 0.04 | . | . | . | 0.60 | 0.69 |
| Ser | 70 | . | . | B | . | . | . | . | . | 0.39 | 0.04 | * | . | . | 0.14 | 0.66 |
| His | 71 | . | . | B | . | . | . | . | . | 0.14 | 0.14 | * | . | . | 0.08 | 0.34 |
| Val | 72 | . | . | B | . | . | . | . | . | −0.16 | 0.64 | * | . | . | −0.28 | 0.49 |
| Pro | 73 | . | . | B | . | . | . | . | . | −0.97 | 0.34 | * | * | . | −0.04 | 0.49 |
| Ala | 74 | . | . | . | . | T | . | . | . | 0.03 | 0.74 | * | * | . | 0.00 | 0.31 |
| Ala | 75 | A | . | . | . | . | . | . | . | −0.26 | 0.24 | . | * | . | −0.10 | 0.82 |
| Ser | 76 | A | . | . | . | . | . | . | . | −0.89 | 0.10 | * | . | . | −0.10 | 0.54 |
| Phe | 77 | A | . | . | . | . | . | . | . | 0.08 | 0.24 | * | . | . | −0.10 | 0.29 |
| Arg | 78 | A | . | . | . | . | . | . | . | 0.29 | −0.26 | * | * | . | 0.60 | 0.55 |
| Ala | 79 | A | . | . | . | . | . | . | . | 0.07 | −0.36 | * | * | . | 0.70 | 0.66 |
| Cys | 80 | A | . | . | . | . | . | T | . | 0.34 | −0.06 | * | * | . | 1.00 | 0.63 |
| Arg | 81 | . | . | . | . | . | T | T | . | −0.24 | −0.36 | * | * | . | 1.50 | 0.47 |
| Asn | 82 | . | . | . | . | . | T | T | . | −0.36 | 0.33 | * | * | . | 1.00 | 0.32 |
| Leu | 83 | . | . | B | . | . | . | T | . | −0.76 | 0.51 | . | . | . | 0.20 | 0.50 |
| Thr | 84 | . | . | B | B | . | . | . | . | −0.98 | 0.86 | * | . | . | −0.30 | 0.27 |
| Ile | 85 | . | . | B | B | . | . | . | . | −0.34 | 1.54 | . | . | . | −0.40 | 0.14 |
| Leu | 86 | . | . | B | B | . | . | . | . | −0.76 | 1.64 | . | . | . | −0.50 | 0.23 |
| Trp | 87 | . | . | B | B | . | . | . | . | −0.76 | 1.34 | . | * | . | −0.60 | 0.21 |
| Leu | 88 | . | . | B | B | . | . | . | . | −0.80 | 1.26 | . | . | . | −0.60 | 0.48 |
| His | 89 | . | . | B | . | . | . | T | . | −1.30 | 1.21 | . | . | . | −0.20 | 0.43 |
| Ser | 90 | . | . | . | . | . | T | C | . | −1.00 | 1.21 | * | * | . | 0.00 | 0.34 |
| Asn | 91 | . | . | . | . | . | T | C | . | −0.08 | 0.80 | * | * | . | 0.00 | 0.42 |
| Val | 92 | A | . | . | . | . | T | . | . | −0.68 | 0.11 | . | * | . | 0.10 | 0.60 |
| Leu | 93 | A | A | . | . | . | . | . | . | 0.13 | 0.30 | . | * | . | −0.30 | 0.31 |
| Ala | 94 | A | A | . | . | . | . | . | . | −0.42 | −0.09 | . | * | . | 0.30 | 0.33 |
| Arg | 95 | A | A | . | . | . | . | . | . | −0.71 | 0.01 | * | * | . | −0.30 | 0.44 |
| Ile | 96 | A | A | . | . | . | . | . | . | −1.30 | −0.13 | . | * | . | 0.30 | 0.54 |
| Asp | 97 | A | A | . | . | . | . | . | . | −1.14 | −0.31 | . | * | . | 0.30 | 0.54 |

TABLE 6-continued

| Res | Position | I | II | III | IV | V | VI | VII | VIII | IX | X | XI | XII | XIII | XIV |
|---|---|---|---|---|---|---|---|---|---|---|---|---|---|---|---|
| Ala | 98 | A | A | . | . | . | . | . | −0.64 | −0.03 | * | * | . | 0.30 | 0.24 |
| Ala | 99 | A | A | . | . | . | . | . | −0.40 | 0.46 | * | * | . | −0.60 | 0.49 |
| Ala | 100 | A | A | . | . | . | . | . | −1.32 | 0.20 | . | * | . | −0.30 | 0.29 |
| Phe | 101 | A | A | . | . | . | . | . | −1.02 | 0.89 | . | . | . | −0.60 | 0.24 |
| Thr | 102 | A | A | . | . | . | . | . | −1.83 | 0.89 | . | . | . | −0.60 | 0.24 |
| Gly | 103 | A | A | . | . | . | . | . | −2.06 | 1.07 | . | . | . | −0.60 | 0.19 |
| Leu | 104 | A | A | . | . | . | . | . | −1.47 | 1.26 | . | . | . | −0.60 | 0.19 |
| Ala | 105 | A | A | . | . | . | . | . | −0.88 | 0.47 | . | . | . | −0.60 | 0.22 |
| Leu | 106 | A | A | . | . | . | . | . | −0.99 | 0.39 | . | * | . | −0.30 | 0.39 |
| Leu | 107 | A | A | . | . | . | . | . | −0.68 | 0.64 | . | * | . | −0.60 | 0.39 |
| Glu | 108 | A | A | . | . | . | . | . | −1.14 | −0.04 | . | * | . | 0.30 | 0.64 |
| Gln | 109 | A | A | . | . | . | . | . | −0.63 | 0.14 | . | * | . | −0.30 | 0.64 |
| Leu | 110 | A | A | . | . | . | . | . | −0.04 | −0.16 | . | * | . | 0.45 | 1.05 |
| Asp | 111 | A | A | . | . | . | . | . | 0.77 | −0.84 | . | * | . | 0.75 | 1.01 |
| Leu | 112 | A | A | . | . | . | . | . | 0.99 | −0.44 | . | * | . | 0.30 | 0.94 |
| Ser | 113 | A | . | . | . | . | T | . | 0.99 | −0.34 | . | * | F | 1.00 | 1.15 |
| Asp | 114 | A | . | . | . | . | T | . | 0.18 | −0.63 | . | * | F | 1.30 | 1.19 |
| Asn | 115 | A | . | . | . | . | T | . | 1.10 | 0.06 | . | * | F | 0.40 | 1.19 |
| Ala | 116 | A | . | . | . | . | T | . | 0.80 | −0.63 | . | * | . | 1.15 | 1.74 |
| Gln | 117 | . | A | B | . | . | . | . | 0.76 | −0.63 | . | * | . | 0.75 | 1.40 |
| Leu | 118 | . | A | B | . | . | . | . | 1.06 | 0.01 | . | * | . | −0.30 | 0.64 |
| Arg | 119 | . | A | B | . | . | . | . | 0.84 | −0.39 | * | * | F | 0.60 | 1.07 |
| Ser | 120 | . | A | B | . | . | . | . | 0.26 | −0.46 | * | * | F | 0.53 | 0.95 |
| Val | 121 | . | . | B | . | . | . | . | 0.53 | −0.36 | . | * | F | 0.96 | 1.17 |
| Asp | 122 | . | . | B | . | . | T | . | −0.17 | −0.56 | . | * | F | 1.39 | 0.86 |
| Pro | 123 | . | . | B | . | . | T | . | 0.61 | 0.23 | * | * | F | 0.57 | 0.55 |
| Ala | 124 | . | . | B | . | . | T | . | 0.16 | 0.34 | * | . | F | 0.80 | 1.02 |
| Thr | 125 | . | . | B | . | . | T | . | −0.36 | 0.13 | . | . | . | 0.42 | 0.60 |
| Phe | 126 | . | . | B | . | . | . | . | 0.16 | 0.81 | . | * | . | −0.16 | 0.32 |
| His | 127 | A | . | . | . | . | . | . | 0.27 | 0.81 | * | * | . | −0.24 | 0.31 |
| Gly | 128 | . | . | . | . | . | . | C | −0.33 | 0.31 | * | * | . | 0.18 | 0.43 |
| Leu | 129 | . | A | . | . | . | . | C | 0.22 | 0.51 | * | * | . | −0.40 | 0.41 |
| Gly | 130 | . | A | . | . | . | . | C | 0.22 | 0.23 | * | * | . | −0.10 | 0.41 |
| Arg | 131 | A | A | . | . | . | . | . | 0.11 | 0.21 | * | * | . | −0.30 | 0.59 |
| Leu | 132 | A | A | . | . | . | . | . | 0.11 | 0.47 | . | * | . | −0.60 | 0.59 |
| His | 133 | . | A | B | . | . | . | . | −0.36 | 0.29 | * | * | . | −0.30 | 0.82 |
| Thr | 134 | . | A | B | . | . | . | . | 0.46 | 0.54 | * | . | . | −0.60 | 0.34 |
| Leu | 135 | . | A | B | . | . | . | . | 0.91 | 0.54 | * | * | . | −0.38 | 0.70 |
| His | 136 | . | A | B | . | . | . | . | 0.13 | −0.14 | * | . | . | 0.89 | 1.00 |
| Leu | 137 | . | A | B | . | . | . | . | 0.60 | −0.07 | . | . | . | 0.96 | 0.37 |
| Asp | 138 | . | . | . | . | T | T | . | −0.18 | −0.13 | * | . | . | 1.98 | 0.45 |
| Arg | 139 | . | . | . | . | T | T | . | 0.13 | −0.13 | . | . | . | 2.20 | 0.27 |
| Cys | 140 | . | . | . | . | T | T | . | 0.94 | −0.23 | * | . | . | 1.98 | 0.57 |
| Gly | 141 | . | . | B | . | . | T | . | 0.17 | −0.91 | * | . | . | 1.66 | 0.59 |
| Leu | 142 | . | A | B | . | . | . | . | 0.63 | −0.23 | * | . | . | 0.74 | 0.25 |
| Gln | 143 | . | A | B | . | . | . | . | 0.42 | 0.20 | * | . | . | −0.08 | 0.46 |
| Glu | 144 | . | A | B | . | . | . | . | −0.03 | 0.06 | * | * | F | −0.15 | 0.72 |
| Leu | 145 | . | A | B | . | . | . | . | −0.18 | 0.06 | * | . | F | −0.15 | 0.86 |
| Gly | 146 | . | . | . | . | . | T | C | −0.53 | 0.06 | * | * | F | 0.45 | 0.41 |
| Pro | 147 | . | . | . | . | T | T | . | 0.39 | 0.44 | * | * | F | 0.35 | 0.20 |
| Gly | 148 | . | . | . | . | . | T | C | 0.04 | 0.44 | * | . | F | 0.15 | 0.49 |
| Leu | 149 | . | . | B | . | . | T | . | −0.77 | 0.19 | * | * | . | 0.10 | 0.49 |
| Phe | 150 | . | A | B | . | . | . | . | −0.54 | 0.44 | * | . | . | −0.60 | 0.26 |
| Arg | 151 | . | A | B | . | . | . | . | −0.79 | 0.51 | * | * | . | −0.60 | 0.26 |
| Gly | 152 | . | A | B | . | . | . | . | −1.39 | 0.59 | * | * | . | −0.60 | 0.32 |
| Leu | 153 | A | A | . | . | . | . | . | −1.04 | 0.59 | * | * | . | −0.60 | 0.31 |
| Ala | 154 | A | A | . | . | . | . | . | −0.48 | 0.20 | * | * | . | −0.30 | 0.27 |
| Ala | 155 | A | A | . | . | . | . | . | −0.59 | 0.96 | * | * | . | −0.60 | 0.43 |
| Leu | 156 | A | A | . | . | . | . | . | −0.94 | 1.21 | . | * | . | −0.60 | 0.43 |
| Gln | 157 | . | A | B | . | . | . | . | −1.41 | 1.29 | . | . | . | −0.60 | 0.67 |
| Tyr | 158 | . | A | B | . | . | . | . | −0.60 | 1.47 | . | . | . | −0.60 | 0.55 |
| Leu | 159 | . | A | B | . | . | . | . | −0.01 | 1.37 | . | . | . | −0.45 | 1.15 |
| Tyr | 160 | . | A | B | . | . | . | . | 0.58 | 0.69 | . | . | . | −0.45 | 1.11 |
| Leu | 161 | . | . | B | . | . | T | . | 0.80 | 0.69 | . | . | . | −0.05 | 1.14 |
| Gln | 162 | . | . | B | . | . | T | . | −0.01 | 0.43 | . | . | . | −0.05 | 1.39 |
| Asp | 163 | . | . | B | . | . | T | . | 0.23 | 0.43 | . | . | . | −0.20 | 0.73 |
| Asn | 164 | . | . | B | . | . | T | . | 0.46 | 0.07 | * | . | . | 0.25 | 1.54 |
| Ala | 165 | . | A | B | . | . | . | . | −0.11 | −0.11 | * | . | . | 0.30 | 0.90 |
| Leu | 166 | . | A | B | . | . | . | . | 0.49 | 0.17 | * | . | . | −0.30 | 0.44 |
| Gln | 167 | . | A | B | . | . | . | . | 0.49 | 0.60 | * | . | . | −0.32 | 0.43 |
| Ala | 168 | . | A | B | . | . | . | . | 0.49 | 0.20 | * | . | . | 0.26 | 0.70 |
| Leu | 169 | . | . | B | . | . | T | . | 0.18 | −0.30 | * | . | . | 1.69 | 1.43 |
| Pro | 170 | . | . | B | . | . | T | . | 0.07 | −0.50 | * | * | F | 2.12 | 1.19 |
| Asp | 171 | . | . | . | . | T | T | . | 0.99 | −0.11 | * | * | F | 2.80 | 1.02 |
| Asp | 172 | . | . | B | . | . | T | . | 0.99 | −0.61 | * | . | F | 2.42 | 2.42 |
| Thr | 173 | . | . | B | . | . | . | . | 0.77 | −1.30 | * | . | F | 1.94 | 2.61 |
| Phe | 174 | . | . | B | . | . | . | . | 1.23 | −1.04 | * | . | F | 1.87 | 1.29 |

TABLE 6-continued

| Res | Position | I | II | III | IV | V | VI | VII | VIII | IX | X | XI | XII | XIII | XIV |
|---|---|---|---|---|---|---|---|---|---|---|---|---|---|---|---|
| Arg | 175 | . | . | B | . | . | . | . | 1.44 | −0.61 | * | * | F | 1.65 | 0.76 |
| Asp | 176 | A | . | . | . | . | . | . | 0.63 | −0.21 | * | * | F | 1.28 | 0.85 |
| Leu | 177 | . | . | . | . | . | T | . | 0.32 | −0.01 | * | * | F | 1.89 | 0.81 |
| Gly | 178 | . | . | . | . | . | T | . | 0.60 | −0.31 | * | * | F | 2.10 | 0.60 |
| Asn | 179 | . | . | . | . | . | . | C | 0.49 | 0.19 | * | * | . | 0.94 | 0.49 |
| Leu | 180 | A | . | . | B | . | . | . | −0.32 | 0.87 | * | . | . | 0.03 | 0.49 |
| Thr | 181 | . | . | B | B | . | . | . | −1.13 | 0.97 | * | . | . | −0.18 | 0.43 |
| His | 182 | . | . | B | B | . | . | . | −0.36 | 1.23 | * | . | . | −0.39 | 0.22 |
| Leu | 183 | . | . | B | B | . | . | . | −0.36 | 1.33 | . | * | . | −0.60 | 0.36 |
| Phe | 184 | . | . | B | B | . | . | . | −0.36 | 1.07 | * | . | . | −0.60 | 0.25 |
| Leu | 185 | . | . | B | B | . | . | . | 0.57 | 0.99 | * | . | . | −0.60 | 0.29 |
| His | 186 | . | . | B | . | . | T | . | −0.01 | 0.49 | * | . | . | −0.20 | 0.69 |
| Gly | 187 | . | . | . | . | . | T | T | . | −0.28 | 0.49 | * | . | F | 0.35 | 0.56 |
| Asn | 188 | . | . | . | . | . | T | T | . | 0.23 | 0.09 | * | . | F | 0.65 | 0.91 |
| Arg | 189 | . | . | . | . | . | T | T | . | 0.08 | −0.21 | . | . | F | 1.25 | 0.90 |
| Ile | 190 | . | . | . | . | . | . | C | 0.68 | −0.07 | . | . | F | 0.85 | 0.67 |
| Ser | 191 | . | . | . | . | . | . | C | 0.71 | −0.07 | * | . | F | 0.85 | 0.65 |
| Ser | 192 | . | . | B | . | . | . | . | 1.17 | −0.47 | * | * | F | 0.65 | 0.57 |
| Val | 193 | . | . | B | . | . | . | . | 0.58 | −0.47 | * | . | F | 0.80 | 1.60 |
| Pro | 194 | . | A | B | . | . | . | . | −0.23 | −0.66 | * | . | F | 0.90 | 1.21 |
| Glu | 195 | . | A | B | . | . | . | . | 0.77 | −0.26 | * | . | F | 0.45 | 0.78 |
| Arg | 196 | A | A | . | . | . | . | . | 0.72 | −0.64 | * | . | F | 0.90 | 2.06 |
| Ala | 197 | A | A | . | . | . | . | . | 0.21 | −0.86 | * | . | . | 0.75 | 1.32 |
| Phe | 198 | A | A | . | . | . | . | . | 1.03 | −0.60 | * | . | . | 0.60 | 0.63 |
| Arg | 199 | A | A | . | . | . | . | . | 0.94 | −0.10 | * | . | . | 0.30 | 0.44 |
| Gly | 200 | A | A | . | . | . | . | . | 0.13 | 0.29 | * | * | . | −0.30 | 0.58 |
| Leu | 201 | A | A | . | . | . | . | . | 0.02 | 0.47 | * | . | . | −0.60 | 0.55 |
| His | 202 | . | A | . | . | . | . | C | 0.72 | −0.31 | * | * | . | 0.50 | 0.47 |
| Ser | 203 | . | A | . | . | . | . | C | 0.61 | −0.31 | * | * | . | 0.50 | 0.93 |
| Leu | 204 | A | A | . | . | . | . | . | −0.31 | −0.06 | * | * | . | 0.30 | 0.93 |
| Asp | 205 | A | A | . | . | . | . | . | −0.78 | −0.06 | * | . | . | 0.30 | 0.56 |
| Arg | 206 | A | A | . | B | . | . | . | 0.00 | 0.13 | * | . | . | −0.30 | 0.35 |
| Leu | 207 | A | A | . | B | . | . | . | 0.03 | 0.24 | * | . | . | −0.30 | 0.57 |
| Leu | 208 | A | A | . | B | . | . | . | 0.33 | −0.04 | * | . | . | 0.30 | 0.59 |
| Leu | 209 | A | A | . | B | . | . | . | 1.26 | 0.36 | * | . | . | −0.30 | 0.49 |
| His | 210 | A | . | . | . | . | T | . | 0.40 | 0.36 | * | . | . | 0.25 | 1.16 |
| Gln | 211 | A | . | . | . | . | T | . | −0.30 | 0.31 | * | * | F | 0.40 | 1.04 |
| Asn | 212 | A | . | . | . | . | T | . | 0.48 | 0.13 | . | . | F | 0.40 | 1.28 |
| Arg | 213 | A | . | . | . | . | T | . | 0.43 | −0.06 | . | . | . | 0.85 | 1.28 |
| Val | 214 | A | A | . | . | . | . | . | 1.21 | 0.09 | . | . | . | −0.30 | 0.55 |
| Ala | 215 | . | A | B | . | . | . | . | 1.03 | 0.19 | . | . | . | −0.30 | 0.46 |
| His | 216 | . | A | B | . | . | . | . | 1.00 | 0.21 | . | * | . | −0.30 | 0.37 |
| Val | 217 | . | A | B | . | . | . | . | 0.41 | 0.71 | * | . | . | −0.60 | 0.67 |
| His | 218 | . | A | B | . | . | . | . | −0.40 | 0.57 | * | . | . | −0.60 | 0.67 |
| Pro | 219 | . | A | B | . | . | . | . | 0.57 | 0.86 | * | . | . | −0.60 | 0.43 |
| His | 220 | A | . | . | . | . | . | . | 1.16 | 0.36 | * | . | . | 0.05 | 1.12 |
| Ala | 221 | A | . | . | . | . | . | . | 0.38 | −0.29 | * | . | . | 0.65 | 1.38 |
| Phe | 222 | A | . | . | . | . | . | . | 0.89 | −0.10 | * | * | . | 0.50 | 0.74 |
| Arg | 223 | A | . | . | . | . | . | . | 1.03 | −0.10 | * | * | . | 0.50 | 0.54 |
| Asp | 224 | A | . | . | . | . | . | . | 0.43 | −0.60 | * | * | F | 1.10 | 1.04 |
| Leu | 225 | A | . | . | . | . | . | . | −0.13 | −0.41 | * | * | F | 0.65 | 0.99 |
| Gly | 226 | A | . | . | . | . | . | . | 0.14 | −0.59 | * | * | F | 0.95 | 0.50 |
| Arg | 227 | A | . | . | B | . | . | . | 0.03 | −0.10 | * | * | . | 0.30 | 0.43 |
| Leu | 228 | . | . | B | B | . | . | . | −0.32 | 0.59 | * | * | . | −0.60 | 0.43 |
| Met | 229 | . | . | B | B | . | . | . | −1.13 | 0.66 | * | . | . | −0.60 | 0.68 |
| Thr | 230 | . | . | B | B | . | . | . | −1.02 | 0.91 | . | . | . | −0.60 | 0.29 |
| Leu | 231 | . | . | B | B | . | . | . | −1.27 | 1.70 | . | * | . | −0.60 | 0.30 |
| Tyr | 232 | . | . | B | B | . | . | . | −1.38 | 1.51 | . | . | . | −0.60 | 0.31 |
| Leu | 233 | . | . | B | B | . | . | . | −0.57 | 1.30 | . | . | . | −0.60 | 0.34 |
| Phe | 234 | A | . | . | . | . | T | . | −0.78 | 1.21 | . | . | . | −0.20 | 0.67 |
| Ala | 235 | A | . | . | . | . | T | . | −0.77 | 1.21 | . | . | . | −0.20 | 0.35 |
| Asn | 236 | A | . | . | . | . | T | . | −0.54 | 0.84 | * | . | . | −0.20 | 0.57 |
| Asn | 237 | . | . | . | . | . | T | C | −1.11 | 0.66 | . | . | . | 0.00 | 0.67 |
| Leu | 238 | . | A | . | . | . | . | C | −0.51 | 0.56 | . | . | . | −0.40 | 0.55 |
| Ser | 239 | . | A | . | . | . | . | C | −0.12 | 0.49 | * | . | . | −0.40 | 0.52 |
| Ala | 240 | . | A | . | . | . | . | C | 0.47 | 0.57 | * | . | . | −0.40 | 0.47 |
| Leu | 241 | . | A | . | . | . | . | C | −0.12 | 0.17 | * | . | . | −0.10 | 0.99 |
| Pro | 242 | A | A | . | . | . | . | . | −0.93 | −0.01 | . | . | F | 0.45 | 0.75 |
| Thr | 243 | A | A | . | . | . | . | . | −0.71 | 0.29 | . | . | F | −0.15 | 0.61 |
| Glu | 244 | A | A | . | . | . | . | . | −0.62 | 0.29 | . | . | F | −0.15 | 0.75 |
| Ala | 245 | A | A | . | . | . | . | . | −0.84 | 0.03 | * | * | . | −0.30 | 0.75 |
| Leu | 246 | A | A | . | . | . | . | . | 0.08 | 0.29 | * | * | . | −0.30 | 0.43 |
| Ala | 247 | A | A | . | . | . | . | . | −0.30 | −0.20 | * | * | . | 0.30 | 0.48 |
| Pro | 248 | A | A | . | . | . | . | . | −0.80 | 0.30 | * | * | . | −0.30 | 0.48 |
| Leu | 249 | A | A | . | . | . | . | . | −0.80 | 0.49 | * | * | . | −0.60 | 0.48 |
| Arg | 250 | A | A | . | . | . | . | . | −0.46 | 0.20 | * | * | . | −0.30 | 0.83 |
| Ala | 251 | A | A | . | . | . | . | . | −0.46 | 0.46 | * | * | . | −0.60 | 0.84 |

TABLE 6-continued

| Res | Position | I | II | III | IV | V | VI | VII | VIII | IX | X | XI | XII | XIII | XIV |
|---|---|---|---|---|---|---|---|---|---|---|---|---|---|---|---|
| Leu | 252 | A | A | . | . | . | . | . | 0.24 | 0.71 | * | * | . | −0.60 | 0.84 |
| Gln | 253 | . | A | B | . | . | . | . | −0.36 | 0.03 | * | * | . | −0.30 | 0.84 |
| Tyr | 254 | . | A | B | . | . | . | . | 0.46 | 0.71 | . | * | . | −0.60 | 0.68 |
| Leu | 255 | . | A | B | . | . | . | . | 0.34 | 0.61 | * | * | . | −0.17 | 1.33 |
| Arg | 256 | . | A | B | . | . | . | . | 0.93 | −0.07 | * | * | . | 1.01 | 1.28 |
| Leu | 257 | . | A | . | . | . | T | . | 1.53 | −0.07 | * | * | . | 1.69 | 1.32 |
| Asn | 258 | . | . | . | . | . | T | T | 1.24 | −0.40 | * | * | F | 2.52 | 2.47 |
| Asp | 259 | . | . | . | . | . | T | T | 0.63 | −0.17 | . | * | F | 2.80 | 1.33 |
| Asn | 260 | . | . | . | . | . | T | C | 0.78 | 0.47 | . | * | F | 1.42 | 1.19 |
| Pro | 261 | . | . | . | . | . | T | T | 0.67 | 0.36 | . | * | F | 1.49 | 0.40 |
| Trp | 262 | . | . | . | . | . | T | . | 0.81 | −0.04 | . | * | . | 1.46 | 0.40 |
| Val | 263 | . | . | B | . | . | . | . | 0.92 | 0.53 | . | * | . | 0.19 | 0.13 |
| Cys | 264 | . | . | B | . | . | T | . | 0.33 | 0.13 | . | * | . | 0.72 | 0.17 |
| Asp | 265 | . | . | B | . | . | T | . | 0.44 | 0.20 | . | * | . | 1.03 | 0.16 |
| Cys | 266 | . | . | B | . | . | T | . | 0.44 | −0.71 | . | * | . | 2.24 | 0.43 |
| Arg | 267 | . | . | . | . | . | T | T | −0.08 | −0.93 | . | * | . | 3.10 | 1.23 |
| Ala | 268 | . | . | . | . | . | T | . | 0.49 | −0.81 | . | * | . | 2.44 | 0.61 |
| Arg | 269 | . | . | . | . | . | T | C | 0.57 | 0.10 | . | * | . | 1.38 | 1.19 |
| Pro | 270 | . | . | . | . | . | T | C | 0.28 | 0.03 | . | * | . | 0.92 | 0.61 |
| Leu | 271 | A | . | . | . | . | T | . | 0.13 | 0.94 | . | * | . | 0.11 | 0.64 |
| Trp | 272 | A | . | . | . | . | T | . | 0.02 | 1.13 | * | * | . | −0.20 | 0.27 |
| Ala | 273 | A | A | . | . | . | . | . | 0.66 | 1.53 | * | . | . | −0.60 | 0.30 |
| Trp | 274 | A | A | . | . | . | . | . | −0.16 | 1.10 | * | * | . | −0.60 | 0.73 |
| Leu | 275 | A | A | . | . | . | . | . | 0.17 | 1.20 | * | * | . | −0.60 | 0.60 |
| Gln | 276 | . | A | B | . | . | . | . | 0.63 | 0.29 | * | * | . | −0.15 | 1.17 |
| Lys | 277 | . | A | B | . | . | . | . | 0.62 | 0.21 | . | * | F | 0.34 | 1.10 |
| Phe | 278 | . | A | . | . | . | T | . | 0.91 | −0.31 | . | * | F | 1.68 | 1.79 |
| Arg | 279 | . | A | . | . | . | T | . | 0.90 | −0.61 | * | * | F | 2.32 | 1.38 |
| Gly | 280 | . | . | . | . | . | T | T | 1.71 | −0.63 | * | * | F | 2.91 | 0.93 |
| Ser | 281 | . | . | . | . | . | T | T | 0.86 | −0.63 | * | * | F | 3.40 | 1.85 |
| Ser | 282 | . | . | . | . | . | T | C | 0.60 | −0.77 | . | * | F | 2.71 | 0.70 |
| Ser | 283 | . | . | . | . | . | T | T | 0.63 | −0.34 | . | * | F | 2.42 | 1.10 |
| Glu | 284 | . | . | . | . | . | T | . | 0.22 | −0.20 | . | * | F | 1.73 | 0.44 |
| Val | 285 | . | . | B | . | . | T | . | −0.24 | −0.20 | . | . | F | 1.19 | 0.44 |
| Pro | 286 | . | . | . | . | . | T | T | −0.16 | 0.10 | . | . | . | 0.50 | 0.27 |
| Cys | 287 | . | . | . | . | . | T | T | 0.14 | 0.14 | . | * | . | 0.50 | 0.24 |
| Ser | 288 | . | . | B | . | . | T | . | 0.56 | 0.54 | * | * | . | −0.20 | 0.56 |
| Leu | 289 | . | . | B | . | . | . | . | −0.26 | −0.10 | * | * | F | 0.65 | 0.71 |
| Pro | 290 | . | . | B | . | . | . | . | 0.01 | 0.16 | . | * | F | 0.20 | 1.10 |
| Gln | 291 | . | A | B | . | . | . | . | −0.12 | 0.09 | * | * | F | −0.15 | 0.83 |
| Arg | 292 | . | A | B | . | . | . | . | 0.66 | 0.13 | * | * | F | −0.15 | 0.99 |
| Leu | 293 | . | A | B | . | . | . | . | 0.96 | −0.56 | * | * | F | 0.90 | 1.26 |
| Ala | 294 | . | A | B | . | . | . | . | 0.96 | −0.99 | * | * | F | 0.90 | 1.21 |
| Gly | 295 | A | . | . | . | . | T | . | 1.21 | −0.70 | * | * | F | 1.15 | 0.51 |
| Arg | 296 | A | . | . | . | . | T | . | 1.32 | −0.70 | * | * | F | 1.30 | 1.24 |
| Asp | 297 | A | . | . | . | . | T | . | 0.40 | −1.39 | * | * | F | 1.30 | 2.40 |
| Leu | 298 | A | . | . | . | . | T | . | 0.62 | −1.20 | * | * | F | 1.30 | 2.00 |
| Lys | 299 | A | A | . | . | . | . | . | 0.62 | −1.13 | * | * | F | 0.90 | 1.03 |
| Arg | 300 | A | A | . | . | . | . | . | 0.97 | −0.63 | * | . | . | 0.60 | 0.62 |
| Leu | 301 | A | A | . | . | . | . | . | 0.86 | −0.23 | * | . | . | 0.45 | 1.22 |
| Ala | 302 | A | A | . | . | . | . | . | 0.04 | −0.91 | * | . | . | 0.75 | 1.01 |
| Ala | 303 | A | A | . | . | . | . | . | 0.86 | −0.23 | * | . | . | 0.30 | 0.43 |
| Asn | 304 | A | A | . | . | . | . | . | 0.47 | 0.17 | * | . | . | −0.30 | 0.90 |
| Asp | 305 | A | A | . | . | . | . | . | −0.31 | −0.09 | * | * | F | 0.45 | 0.88 |
| Leu | 306 | A | . | . | . | . | T | . | −0.09 | −0.01 | . | . | F | 0.85 | 0.47 |
| Gln | 307 | . | . | B | . | . | T | . | −0.36 | −0.01 | . | . | . | 0.70 | 0.29 |
| Gly | 308 | . | . | B | . | . | T | . | −0.36 | 0.23 | . | . | . | 0.10 | 0.13 |
| Cys | 309 | . | . | B | . | . | T | . | −0.67 | 0.73 | . | . | . | −0.20 | 0.16 |
| Ala | 310 | . | . | B | B | . | . | . | −1.01 | 0.53 | . | * | . | −0.60 | 0.13 |
| Val | 311 | . | . | B | B | . | . | . | −0.41 | 0.56 | . | . | . | −0.60 | 0.13 |
| Ala | 312 | . | . | B | B | . | . | . | −0.66 | 0.56 | . | . | . | −0.60 | 0.38 |
| Thr | 313 | . | . | B | B | . | . | . | −0.34 | 0.74 | . | . | F | −0.45 | 0.59 |
| Gly | 314 | . | . | B | . | . | T | . | 0.11 | 0.74 | . | . | F | 0.10 | 1.09 |
| Pro | 315 | . | . | . | . | . | T | T | −0.19 | 0.53 | . | . | F | 0.50 | 1.67 |
| Tyr | 316 | . | . | . | . | . | T | C | 0.38 | 0.71 | . | . | . | 0.00 | 0.81 |
| His | 317 | . | . | B | . | . | T | . | 0.66 | 1.14 | . | . | . | −0.20 | 0.86 |
| Pro | 318 | . | . | B | . | . | . | . | 0.62 | 1.20 | . | * | . | −0.40 | 0.80 |
| Ile | 319 | . | . | B | . | . | . | . | 1.08 | 1.20 | . | * | . | −0.40 | 0.51 |
| Trp | 320 | . | . | B | . | . | T | . | 0.70 | 0.44 | . | * | . | −0.20 | 0.73 |
| Thr | 321 | . | . | B | . | . | T | . | 0.63 | 0.44 | . | * | F | −0.05 | 0.48 |
| Gly | 322 | . | . | . | . | . | T | C | 0.67 | 0.50 | . | * | F | 0.15 | 0.98 |
| Arg | 323 | . | . | . | . | . | T | C | 0.88 | −0.19 | . | * | F | 1.20 | 1.56 |
| Ala | 324 | . | A | . | . | . | . | C | 1.77 | −1.10 | . | * | F | 1.10 | 1.87 |
| Thr | 325 | . | A | . | . | . | . | C | 1.84 | −1.59 | . | * | F | 1.41 | 3.28 |
| Asp | 326 | . | A | . | . | . | . | C | 1.34 | −1.59 | . | * | F | 1.72 | 2.59 |
| Glu | 327 | . | A | B | . | . | . | . | 1.34 | −0.90 | . | * | F | 1.83 | 2.11 |
| Glu | 328 | A | . | . | . | . | T | . | 0.42 | −0.97 | . | * | F | 2.54 | 1.45 |

TABLE 6-continued

| Res | Position | I | II | III | IV | V | VI | VII | VIII | IX | X | XI | XII | XIII | XIV |
|---|---|---|---|---|---|---|---|---|---|---|---|---|---|---|---|
| Pro | 329 | . | . | . | . | . | T | T | . | 0.80 | -0.77 | . | . | F | 3.10 | 0.72 |
| Leu | 330 | . | . | . | . | . | . | . | . | 1.16 | -0.34 | . | . | F | 2.49 | 0.64 |
| Gly | 331 | . | . | . | . | . | T | T | . | 0.49 | -0.34 | . | . | F | 2.18 | 0.74 |
| Leu | 332 | . | . | . | . | . | . | . | C | -0.18 | 0.23 | . | . | . | 0.72 | 0.26 |
| Pro | 333 | . | . | . | . | . | T | T | . | -0.18 | 0.37 | . | . | . | 0.81 | 0.17 |
| Lys | 334 | . | . | . | . | . | T | T | . | -0.18 | 0.09 | . | . | . | 0.50 | 0.29 |
| Cys | 335 | . | . | B | . | . | . | T | . | 0.63 | 0.09 | . | . | . | 0.10 | 0.55 |
| Cys | 336 | . | . | B | . | . | . | T | . | 0.39 | -0.60 | . | . | . | 1.00 | 0.59 |
| Gln | 337 | . | . | B | . | . | . | T | . | 0.61 | -0.53 | . | . | . | 1.00 | 0.30 |
| Pro | 338 | . | . | B | . | . | . | T | . | 0.82 | -0.03 | . | . | F | 0.85 | 0.56 |
| Asp | 339 | A | . | . | . | . | . | T | . | 0.82 | -0.60 | . | . | F | 1.30 | 1.75 |
| Ala | 340 | A | . | . | . | . | . | T | . | 0.90 | -1.17 | . | * | F | 1.30 | 2.02 |
| Ala | 341 | A | A | . | . | . | . | . | . | 1.27 | -1.07 | . | * | F | 0.90 | 1.32 |
| Asp | 342 | A | A | . | . | . | . | . | . | 0.41 | -1.11 | . | * | F | 0.90 | 1.06 |
| Lys | 343 | A | A | . | . | . | . | . | . | -0.19 | -0.47 | . | . | F | 0.45 | 0.78 |
| Ala | 344 | A | A | . | . | . | . | . | . | -0.19 | -0.29 | . | . | F | 0.45 | 0.63 |
| Ser | 345 | . | A | B | . | . | . | . | . | 0.19 | -0.79 | . | . | . | 0.60 | 0.66 |
| Val | 346 | . | A | B | . | . | . | . | . | 0.43 | -0.36 | . | * | . | 0.64 | 0.51 |
| Leu | 347 | . | A | B | . | . | . | . | . | 0.54 | 0.07 | . | * | . | 0.38 | 0.50 |
| Glu | 348 | . | . | B | . | . | . | T | . | 0.29 | -0.43 | * | * | F | 1.87 | 0.73 |
| Pro | 349 | . | . | . | . | T | T | . | . | 0.29 | -0.39 | * | . | F | 2.76 | 1.52 |
| Gly | 350 | . | . | . | . | T | T | . | . | 0.29 | -0.53 | * | . | F | 3.40 | 1.86 |
| Arg | 351 | . | . | . | . | . | T | C | . | 0.56 | -0.83 | * | . | F | 2.86 | 1.44 |
| Pro | 352 | . | . | . | . | . | . | C | . | 1.02 | -0.33 | . | . | F | 1.87 | 0.94 |
| Ala | 353 | A | . | . | . | . | . | . | . | 1.02 | -0.33 | . | . | F | 1.33 | 0.94 |
| Ser | 354 | A | . | . | . | . | . | T | . | 0.64 | -0.36 | . | . | F | 1.19 | 0.77 |
| Ala | 355 | A | . | . | . | . | . | T | . | 0.18 | 0.14 | . | * | F | 0.25 | 0.50 |
| Gly | 356 | A | . | . | . | . | . | T | . | 0.11 | 0.40 | . | * | F | 0.25 | 0.41 |
| Asn | 357 | . | . | B | . | . | . | T | . | -0.02 | -0.10 | . | * | . | 0.70 | 0.61 |
| Ala | 358 | . | . | B | . | . | . | . | . | 0.68 | -0.06 | . | * | F | 0.65 | 0.60 |
| Leu | 359 | . | . | B | . | . | . | . | . | 0.12 | -0.56 | . | * | F | 1.10 | 1.19 |
| Lys | 360 | . | . | B | . | . | . | . | . | 0.50 | -0.34 | . | * | F | 0.65 | 0.55 |
| Gly | 361 | . | . | B | . | . | . | . | . | 0.63 | -0.31 | . | * | F | 0.96 | 0.84 |
| Arg | 362 | . | . | B | . | . | . | . | . | 0.29 | -0.39 | . | * | F | 1.42 | 1.58 |
| Val | 363 | . | . | B | . | . | . | . | . | 0.88 | -0.64 | . | * | F | 1.88 | 0.78 |
| Pro | 364 | . | . | B | . | . | . | T | . | 1.39 | -0.64 | . | * | F | 2.54 | 1.32 |
| Pro | 365 | . | . | . | . | T | T | . | . | 1.13 | -0.69 | . | * | F | 3.10 | 0.90 |
| Gly | 366 | . | . | . | . | T | T | . | . | 1.27 | -0.26 | . | * | F | 2.64 | 1.88 |
| Asp | 367 | . | . | . | . | . | T | T | . | 0.81 | -0.47 | . | . | F | 2.33 | 1.88 |
| Ser | 368 | . | . | . | . | . | . | . | C | 1.67 | -0.47 | . | . | F | 1.62 | 1.20 |
| Pro | 369 | . | . | . | . | . | T | . | C | 1.53 | -0.50 | . | . | F | 1.81 | 1.95 |
| Pro | 370 | . | . | . | . | T | T | . | . | 1.44 | -0.50 | . | . | F | 2.00 | 1.16 |
| Gly | 371 | . | . | . | . | T | T | . | . | 1.44 | -0.11 | . | . | F | 2.00 | 1.16 |
| Asn | 372 | . | . | . | . | T | T | . | . | 1.23 | -0.07 | . | . | F | 2.15 | 0.74 |
| Gly | 373 | . | . | . | . | T | T | . | . | 1.64 | -0.07 | . | . | F | 2.45 | 0.74 |
| Ser | 374 | . | . | . | . | . | T | C | . | 1.82 | -0.50 | * | . | F | 3.00 | 1.47 |
| Gly | 375 | . | . | . | . | . | T | C | . | 1.14 | -0.43 | * | . | F | 2.40 | 1.24 |
| Pro | 376 | . | . | B | . | . | . | T | . | 1.49 | -0.14 | * | . | F | 1.75 | 0.88 |
| Arg | 377 | . | . | B | . | . | . | . | . | 1.49 | -0.17 | * | . | F | 1.40 | 1.05 |
| His | 378 | . | . | B | . | . | . | . | . | 1.53 | -0.56 | * | . | . | 1.25 | 1.78 |
| Ile | 379 | . | . | B | . | . | . | . | . | 1.62 | -0.60 | * | . | . | 1.20 | 1.54 |
| Asn | 380 | . | . | B | . | . | . | . | . | 1.27 | -0.60 | * | . | F | 1.60 | 1.22 |
| Asp | 381 | . | . | . | . | T | . | . | . | 1.13 | 0.19 | * | . | F | 1.20 | 0.77 |
| Ser | 382 | . | . | . | . | . | T | C | . | 0.71 | 0.11 | * | . | F | 1.60 | 1.09 |
| Pro | 383 | . | . | . | . | . | T | T | . | -0.07 | -0.09 | . | . | F | 2.50 | 0.98 |
| Phe | 384 | . | . | . | . | . | T | T | . | 0.61 | 0.20 | . | . | F | 1.65 | 0.48 |
| Gly | 385 | . | . | . | . | . | T | T | . | 0.27 | 0.63 | . | . | F | 1.10 | 0.56 |
| Thr | 386 | . | . | B | . | . | . | . | . | -0.03 | 0.67 | . | . | F | 0.49 | 0.36 |
| Leu | 387 | . | . | . | . | . | T | C | . | -0.32 | 0.63 | . | . | F | 0.88 | 0.55 |
| Pro | 388 | . | . | . | . | . | T | C | . | -0.11 | 0.34 | . | * | F | 1.17 | 0.57 |
| Gly | 389 | . | . | . | . | . | T | T | . | 0.38 | -0.09 | . | . | F | 2.21 | 0.68 |
| Ser | 390 | . | . | . | . | . | T | C | . | 0.51 | -0.14 | . | * | F | 2.40 | 1.27 |
| Ala | 391 | . | . | . | . | . | . | C | . | 0.23 | -0.40 | . | * | F | 1.96 | 1.27 |
| Glu | 392 | . | . | . | . | . | . | C | . | 1.01 | -0.33 | . | * | F | 1.72 | 1.30 |
| Pro | 393 | . | . | B | . | . | . | . | . | 0.56 | -0.26 | . | * | F | 1.28 | 1.32 |
| Pro | 394 | A | . | . | . | . | . | T | . | 0.60 | -0.07 | . | * | F | 1.09 | 0.70 |
| Ala | 395 | A | . | . | . | . | . | T | . | 0.31 | -0.19 | . | * | . | 0.70 | 0.54 |
| His | 396 | A | . | . | . | . | . | T | . | 0.31 | 0.31 | . | * | . | 0.10 | 0.35 |
| Cys | 397 | A | . | . | . | . | . | T | . | 0.42 | 0.39 | . | * | . | 0.10 | 0.23 |
| Ser | 398 | A | . | . | . | . | . | . | . | 0.29 | -0.04 | * | . | . | 0.50 | 0.45 |
| Ala | 399 | A | . | . | . | . | . | . | . | -0.31 | -0.11 | * | . | . | 0.50 | 0.33 |
| Ala | 400 | A | . | . | . | . | . | . | . | 0.39 | 0.07 | * | . | . | -0.10 | 0.50 |
| Arg | 401 | A | . | . | . | . | . | . | . | -0.17 | -0.50 | * | . | . | 0.80 | 0.73 |
| Gly | 402 | A | . | . | . | . | . | . | . | 0.19 | -0.39 | * | . | . | 0.50 | 0.73 |
| Leu | 403 | . | . | B | B | . | . | . | . | 0.60 | -0.40 | * | . | . | 0.45 | 1.05 |
| Arg | 404 | . | . | B | B | . | . | . | . | 0.49 | -0.90 | * | . | . | 0.75 | 1.05 |
| Ala | 405 | . | . | B | B | . | . | . | . | 0.87 | -0.11 | * | . | . | 0.30 | 0.92 |

TABLE 6-continued

| Res | Position | I | II | III | IV | V | VI | VII | VIII | IX | X | XI | XII | XIII | XIV |
|---|---|---|---|---|---|---|---|---|---|---|---|---|---|---|---|
| Thr | 406 | . | . | B | B | . | . | . | 0.44 | −0.11 | * | . | F | 0.60 | 1.72 |
| Arg | 407 | . | . | B | B | . | . | . | 0.49 | −0.31 | * | . | F | 0.60 | 1.26 |
| Phe | 408 | . | . | B | . | . | . | . | 0.96 | 0.07 | * | * | F | 0.40 | 1.68 |
| Pro | 409 | . | . | . | . | . | T | T | 0.63 | 0.00 | * | . | F | 1.74 | 1.15 |
| Thr | 410 | . | . | . | . | . | T | T | 1.33 | −0.06 | * | * | F | 1.93 | 0.91 |
| Ser | 411 | . | . | . | . | . | T | C | 1.76 | −0.06 | * | * | F | 2.22 | 2.05 |
| Gly | 412 | . | . | . | . | . | T | C | 1.76 | −0.84 | * | * | F | 2.86 | 2.60 |
| Pro | 413 | . | . | . | . | T | T | . | 2.24 | −1.27 | . | . | F | 3.40 | 3.53 |
| Arg | 414 | . | . | . | . | T | T | . | 2.11 | −1.33 | . | . | F | 3.06 | 4.08 |
| Arg | 415 | . | . | . | . | T | T | . | 1.76 | −1.29 | . | . | F | 2.72 | 4.08 |
| Arg | 416 | . | . | B | . | . | T | . | 1.76 | −1.14 | . | . | F | 1.98 | 1.41 |
| Pro | 417 | . | . | . | . | . | T | T | 2.21 | −1.19 | . | . | F | 2.23 | 0.97 |
| Gly | 418 | . | . | . | . | . | T | T | 2.47 | −1.19 | . | . | F | 2.23 | 0.97 |
| Cys | 419 | . | . | . | . | . | T | T | 2.36 | −1.19 | . | . | F | 2.57 | 0.99 |
| Ser | 420 | . | . | . | . | . | T | . | 2.36 | −0.79 | . | . | F | 2.86 | 1.03 |
| Arg | 421 | . | . | . | . | . | T | T | 1.93 | −1.21 | . | * | F | 3.40 | 2.03 |
| Lys | 422 | . | . | . | . | . | T | T | 2.26 | −1.16 | . | * | F | 3.06 | 5.47 |
| Asn | 423 | . | . | . | . | . | T | T | 2.30 | −1.73 | . | * | F | 2.98 | 7.99 |
| Arg | 424 | . | . | . | . | . | T | T | 2.93 | −1.73 | . | * | F | 2.90 | 5.47 |
| Thr | 425 | . | . | . | . | . | T | . | 2.57 | −1.23 | . | * | F | 2.62 | 3.72 |
| Arg | 426 | . | . | . | . | . | T | T | 2.57 | −0.66 | . | * | F | 2.74 | 1.24 |
| Ser | 427 | . | . | B | . | . | T | . | 1.71 | −1.06 | * | * | F | 2.60 | 1.24 |
| His | 428 | . | . | B | . | . | T | . | 1.37 | −0.37 | * | * | . | 1.74 | 0.71 |
| Cys | 429 | . | . | B | . | . | T | . | 1.26 | −0.43 | * | * | . | 1.48 | 0.36 |
| Arg | 430 | . | . | B | . | . | . | . | 0.98 | −0.03 | * | * | . | 1.02 | 0.46 |
| Leu | 431 | . | . | B | . | . | . | . | 0.52 | 0.09 | * | * | . | 0.16 | 0.34 |
| Gly | 432 | . | . | B | . | . | . | . | 0.52 | 0.01 | . | * | . | −0.10 | 0.63 |
| Gln | 433 | . | . | B | . | . | . | . | 0.21 | −0.17 | * | * | F | 0.65 | 0.43 |
| Ala | 434 | . | . | B | . | . | . | . | 0.53 | 0.26 | * | . | F | 0.05 | 0.52 |
| Gly | 435 | . | . | . | . | . | T | C | 0.08 | 0.00 | * | . | F | 1.05 | 0.52 |
| Ser | 436 | . | . | . | . | . | T | C | 0.54 | 0.00 | . | . | F | 1.05 | 0.30 |
| Gly | 437 | . | . | . | . | . | T | C | 0.58 | 0.03 | . | . | F | 0.45 | 0.29 |
| Gly | 438 | . | . | . | . | . | T | C | 0.23 | 0.01 | . | . | F | 0.71 | 0.43 |
| Gly | 439 | . | . | . | . | . | T | C | 0.82 | 0.01 | . | . | F | 0.97 | 0.31 |
| Gly | 440 | . | . | . | . | . | T | C | 0.87 | −0.37 | . | . | F | 1.83 | 0.53 |
| Thr | 441 | . | . | . | . | . | T | C | 1.17 | −0.41 | . | . | F | 2.09 | 0.72 |
| Gly | 442 | . | . | B | . | . | T | . | 1.17 | −0.84 | . | . | F | 2.60 | 1.26 |
| Asp | 443 | . | . | B | . | . | T | . | 1.21 | −0.84 | . | * | F | 2.34 | 1.26 |
| Ser | 444 | . | . | B | . | . | T | . | 1.21 | −0.89 | . | . | F | 2.29 | 1.17 |
| Glu | 445 | . | . | B | . | . | T | . | 0.97 | −0.94 | . | * | F | 2.24 | 1.17 |
| Gly | 446 | . | . | . | . | . | T | T | 0.47 | −0.87 | . | * | F | 2.44 | 0.71 |
| Ser | 447 | . | . | . | . | . | T | . | 0.60 | −0.19 | . | * | F | 1.89 | 0.43 |
| Gly | 448 | . | . | . | . | . | T | . | 0.30 | −0.14 | . | . | F | 2.10 | 0.39 |
| Ala | 449 | . | . | . | . | . | . | C | −0.21 | 0.24 | . | . | F | 1.09 | 0.52 |
| Leu | 450 | . | . | B | . | . | T | . | −0.52 | 0.50 | . | . | F | 0.58 | 0.32 |
| Pro | 451 | . | . | B | . | . | T | . | −0.84 | 0.60 | . | . | F | 0.37 | 0.47 |
| Ser | 452 | . | . | B | . | . | T | . | −0.84 | 0.74 | . | . | F | 0.16 | 0.25 |
| Leu | 453 | . | . | B | . | . | T | . | −1.31 | 0.63 | . | . | . | −0.20 | 0.41 |
| Thr | 454 | . | . | B | . | . | . | . | −1.03 | 0.63 | . | . | . | −0.40 | 0.22 |
| Cys | 455 | . | . | B | . | . | . | . | −0.43 | 0.69 | * | . | . | −0.40 | 0.23 |
| Ser | 456 | . | . | B | . | . | T | . | −1.03 | 0.73 | . | . | . | −0.40 | 0.44 |
| Leu | 457 | . | . | B | . | . | . | . | −1.08 | 0.73 | . | . | . | −0.40 | 0.25 |
| Thr | 458 | . | . | B | . | . | T | . | −1.08 | 0.67 | . | . | F | −0.05 | 0.46 |
| Pro | 459 | . | . | B | . | . | T | . | −1.36 | 0.79 | . | . | F | −0.05 | 0.28 |
| Leu | 460 | . | . | B | . | . | T | . | −1.50 | 0.90 | . | . | . | −0.20 | 0.35 |
| Gly | 461 | . | . | B | . | . | T | . | −2.06 | 0.90 | . | . | . | −0.20 | 0.20 |
| Leu | 462 | . | . | B | B | . | . | . | −2.06 | 1.06 | . | . | . | −0.60 | 0.10 |
| Ala | 463 | . | . | B | B | . | . | . | −2.03 | 1.31 | . | . | . | −0.60 | 0.10 |
| Leu | 464 | . | . | B | B | . | . | . | −2.13 | 1.54 | . | . | . | −0.60 | 0.10 |
| Val | 465 | . | . | B | B | . | . | . | −2.18 | 1.60 | . | . | . | −0.60 | 0.18 |
| Leu | 466 | . | . | B | B | . | . | . | −2.64 | 1.56 | . | . | . | −0.60 | 0.13 |
| Trp | 467 | . | . | B | B | . | . | . | −2.18 | 1.74 | . | . | . | −0.60 | 0.13 |
| Thr | 468 | . | . | B | B | . | . | . | −1.80 | 1.49 | . | . | . | −0.60 | 0.17 |
| Val | 469 | . | . | B | B | . | . | . | −1.66 | 1.27 | . | . | . | −0.60 | 0.33 |
| Leu | 470 | . | . | B | B | . | . | . | −1.19 | 1.16 | . | . | . | −0.60 | 0.17 |
| Gly | 471 | . | . | . | B | . | . | C | −0.77 | 0.67 | . | . | . | −0.40 | 0.15 |
| Pro | 472 | . | . | . | . | . | T | . | −0.87 | 0.61 | . | . | . | 0.00 | 0.25 |
| Cys | 473 | . | . | . | . | . | T | . | −0.94 | 0.40 | . | . | . | 0.30 | 0.39 |

LENGTHY TABLES

The patent contains a lengthy table section. A copy of the table is available in electronic form from the USPTO web site (http://seqdata.uspto.gov/?pageRequest=docDetail&DocID=US07838636B1). An electronic copy of the table will also be available from the USPTO upon request and payment of the fee set forth in 37 CFR 1.19(b)(3).

SEQUENCE LISTING (550 sequences)

SEQ ID NO: 1 - DNA, 733 bp, Homo sapiens
gggatccggagcccaaatcttctgacaaaactcacacatgcccaccgtgcccagcacctgaattcgagggtgcaccgtcagtcttcctcttccccccaaaacccaaggacaccctcatgatctcccggactcctgaggtcacatgcgtggtggtggacgtaagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaacccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgagtgcgacggccgcgactctagaggat

SEQ ID NO: 2 - protein, 5 aa, Homo sapiens
  Site (3): Xaa equals any of the twenty naturally ocurring L-amino acids
WSXWS

SEQ ID NO: 3 - DNA, 86 bp, Artificial Sequence
  Primer_Bind: Synthetic sequence with 4 tandem copies of the GAS binding site found in the IRF1 promoter (Rothman et al., Immunity 1:457-468 (1994)), 18 nucleotides complementary to the SV40 early promoter, and a Xho I restriction site.
gcgcctcgagatttccccgaaatctagatttccccgaaatgatttccccgaaatgatttccccgaaatatctgccatctcaattag

SEQ ID NO: 4 - DNA, 27 bp, Artificial Sequence
  Primer_Bind: Synthetic sequence complementary to the SV40 promter; includes a Hind III restriction site.
gcggcaagctttttgcaaagcctaggc

SEQ ID NO: 5 - DNA, 271 bp, Artificial Sequence
  Protein_Bind: Synthetic promoter for use in biological assays; includes GAS binding sites found in the IRF1 promoter (Rothman et al., Immunity 1:457-468 (1994)).
ctcgagatttccccgaaatctagatttccccgaaatgatttccccgaaatgatttccccgaaatatctgccatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctt

SEQ ID NO: 6 - DNA, 32 bp, Artificial Sequence
  Primer_Bind: Synthetic primer complementary to human genomic EGR-1 promoter sequence (Sakamoto et al., Oncogene 6:867-871 (1991)); includes a Xho I restriction site.
gcgctcgagggatgacagcgatagaaccccgg

SEQ ID NO: 7 - DNA, 31 bp, Artificial Sequence
  Primer_Bind: Synthetic primer complementary to human genomic EGR-1 promoter sequence (Sakamoto et al., Oncogene 6:867-871 (1991)); includes a Hind III restriction site.
gcgaagcttcgcgactccccggatccgcctc

SEQ ID NO: 8 - DNA, 12 bp, Homo sapiens
ggggactttccc

SEQ ID NO: 9 - DNA, 73 bp, Artificial Sequence
  Primer_Bind: Synthetic primer with 4 tandem copies of the NF-KB binding site (GGGGACTTTCCC), 18 nucleotides complementary to the 5' end of the SV40 early promoter sequence, and a XhoI restriction site.
gcggcctcgaggggactttcccggggactttccggggactttccgggactttccatcctgccatctcaattag

SEQ ID NO: 10 - DNA, 256 bp, Artificial Sequence
  Protein_Bind: Synthetic promoter for use in biological assays; includes NF-KB binding sites.
ctcgaggggactttcccggggactttccggggactttccgggactttccatctgccatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctt

SEQ ID NO: 11 - DNA, 899 bp, Homo sapiens
ccacgcgtccggaaaaagtacaagcccctctcaaatggttcaagtttcaaatattagacccacccatggcaaagacagattttagtataatactcctaaaactacactgtcttttttttttttctgtcataagtgtgcattgtgctcagtcatttatttcagtgacccaaacagagcccagtccagctgtttgtattttccctgcagtgggaagtggactagggccatgtgactaagaaagccagcctgggggctgtcttttcacctacagatgttttaatgtgcttaacattatccaatactagcaaccgagatagtctaaataccacagcaggatctgattagctttttcagatcactgcctttatttgctgtttgcaaaaaagcttaatccagtgctagagatcaggcttcctgctgagccctggggtagtttctctcattctttgtgttcacagtggcaggcgttagtgagcagattcctcctcctcctaaattaaagctgtaaagtagtaactgtagtagcaagggataaagagaaggaagaaaacccaagggaaaaaagaagactgtctattcataccaagtagtttccttgatatacacaaaagaaagagtttctaatatgaattcataaatactgacctcagtgtctcttctactcagtgcacagctattaagttttattaggtttcagttgtaactactttgtgtggatatatgttacgtttttcatatttatcctactcaatcaatctcagttttaccagaagaattacatttattagccataacagtggcccttctcttattcttttcagggctgatatcttttttattcatgagatttcaaaaagaactatcaccaccactaacaaaaaaaaaaaaaaaaaaaaaaa

SEQ ID NO: 12 - DNA, 1140 bp, Homo sapiens
cccacgcgtccgctgatgttattagcagcataaggcagtcatcgatgaggcttgagggggccttcttgtggggtcacggtcacctttccacagtacaggacttcgaacttctgagagttgtaaaaggcgtcctcattatctttgctgggtttggcatcctctttcatggccgmtttagataattgccttatgctgctaataacatcaggaacctggctggggtctgtggcgcggaaaacgtggcaggccatctgcgactcggggtcgtcgggctgcgccttgatcaggtaggcaaagtaggtgaggtcgtggctgttgtggatgaagcgcgagatatgctgcgccttgtgctcgaagatgaataccgccgggttgggctgcgtggccgacggactagtgccccccgaggccccagcgcccggcgcggggacgcaacgcaggaagggcgcgctgagcaccaggatcacctctcgggccgccggcgccccgcagccgcccgcctcgggcttctggctgcgcctgcggatctcggccatgagccagggcagcataggcagcgtggtcctgtggtccaggcacgaccccccaacgtaccacagccggaaccgcttatcgcttggcttcccggggccgggctgagctgagacgcccggctcgggctccagggggtgcgggaacggctcatcctgaatgcagctgggcggctycataactctcgcctcaccagggcaccgcggaggccggccgggcgcaccgcgccccccactcccgcgcagaaggcgccgccgaaactgtgccaactgccgcaccgggctyccgcgcctgcctgggagcggcgcgaccccgaactccgcgcttcagcagccctgccccatgcagcacttccacgggcgcggctcggaggctccggcggcgggcaccgaggcaagcgcccggcaggcgagggcgggttaaatgggcatcctcctcctcgggctggcgcctcgggcaggacctccccttcctccgtcgcgggtttgcagggtcagaggaccacgccgagggtccccgcggccgctctagaggatccctcgaggggcccaagcttasgcgtgcatgsgacgtcatagctaatctccctatagggagttgcaaaagggt

SEQ ID NO: 13 - DNA, 1445 bp, Homo sapiens
ggaaggctgcaggaccaggaccgaaaaaggactaggaggctgggatcagcaacaactggggaaggccaaggaagactgacctgaggggaaaggagaaactggggaggtgaggtctactactcaacaggatattcttcaaggaaaatgaaccccacactaggcctggccatttttctggctgttctcctcacggtgaaaggtcttctaaagccgagcttctcaccaaggaattataaagctttgagcgaggtccaaggatggaagcaaaggatggcagccaaggagcttgcaaggcagaacatggacttaggctttaagctgctcaagaagctggccttttacaaccctggcaggaacatcttcctatcccccttgagcatctctacagctttctccatgctgtgcctgggtgcccaggacagcaccctggacgagatcaagcaggggttcaacttcagaaagatgccagaaaaagatcttcatgagggcttccattacatcatccacgagctgacccagaagacccaggacctcaaactgagcattgggaacacgctgttcattgaccagaggctgcagccacagcgtaagtttttggaagatgccaagaacttttacagtgccgaaaccatccttaccaactttcagaatttggaaatggctcagaagcagatcaatgactttatcagtcaaaaaacccatgggaaaattaacaacctgatcgagaatatagaccccggcactgtgatgcttcttgcaaattatattttctttcgagccaggtggaaacatgagtttgatccaaatgtaactaaagaggaagatttctttctggagaaaaacagttcagtcaaggtgcccatgatgttccgtagtggcatataccaagttggctatgacgataagctctcttgcaccatcctggaaataccctaccagaaaaatatcacagccatcttcatccttcctgatgagggcaagctgaagcacttggagaagggattgcaggtggacactttctccagatggaaaacattactgtcacgcagggtcgtagacgtgtctgtacccagactccacatgacgggcaccttcgacctgaagaagactctctcctacataggtgtctccaaaatctttgaggaacatggtgatctcaccaagatcgcccctcatcgcagcctgaaagtgggcgaggctgtgcacaaggctgagctgaagatggatgagaggggtacggaaggggccgctggcaccggagcacagactctgcccatggagacaccactcgtcgtcaagatagacaaaccctatctgctgctgatttacagcgagaaaataccttccgtgctcttcctgggaaagattgttaaccctattggaaaataaaggagaattcctgcttgccacagaccccgaaaaaaaaaaaaaaaaagggcggccgc

SEQ ID NO: 14 - DNA, 1208 bp, Homo sapiens
  misc_feature (9)..(9): n equals a,t,g, or c
  misc_feature (59)..(59): n equals a,t,g, or c
  misc_feature (79)..(79): n equals a,t,g, or c
  misc_feature (814)..(814): n equals a,t,g, or c
tagcgcggncgatccattccccagaacactataccctagctttcaaaactattagtgcntataaaggtcgcctcaggtncggtcgaattcccggtcgacccacgcgtccgctagaaagagaggtagtgctctgcagggccacgggaggactcagtgacgacttgaaagcatcaaacacagtggagggctcatacggggtgctcagtagatgggcgcatcattttatagaatactgaggcccagagagggaaggtgtcttgtctgtggtcgcatgggggctcagtgggaaagccgggactaaaagctggccccaggctagctttgtgccaggccatcctgctcttacacaggggctgagaaccaggggcagcccaggagtcctggatggggcagcagtcatgttggatggggctggggtgttggctctccctttctgggctctcaggagtggtcagggctagccccagatctcccagaccaagaagaggagcagcctgtggggagacactcatgccctgacatgagtcagtgcatcaagagaggccatcagccagtgggattcagcaagcatgcctggcgctgcctggtagggtgctgcccatgggaggaagagaagaggagctgccacccatttggggccytccttctctgggtcctcagatttgcccttcagcccaragtctatgaagaccccgcggccctggatggtggggaggagggcatggacatcwttacccacattctggccttggcaccccggctcctgaaagactctggtagtatcttcttagaagtggacccaaggcacccggancttgtcagcagctggcttcagagccggcctgacctgtaccttaatcttgtggctgtgcgcagggacttctgtgggaggccccggttcctgcatatccggaggtctgggccatagcatggctgccctgtggatgccttgtcagtgccgccagcctgaccagaggggaggtggatggcactttccagagcccaggttcttatggcatttcccagggttctgtgatttccccatgctctgcatttctaggatatttctaggacacctggattggctccatcacatcagagtggctgagggcagttgctctgtgttggtgaaattgctgtgggggtatcgggggatatggccagtaaagtattgagagactaacaaaaaaaaaaaaaaaaaaactcga

SEQ ID NO: 15 - DNA, 1175 bp, Homo sapiens
gagcgggccgaggactccagcgtgcccaggtctggcatcctgcacttgctgccctctgacacctgggaagatggccggcccgtggaccttcacccttctctgtggtttgctggcagccaccttgatccaagccaccctcagtcccactgcagttctcatcctcggcccaaaagtcatcaaagaaaagctgacacaggagctgaaggaccacaacgccaccagcatcctgcagcagctgccgctgctcagtgccatgcgggaaaagccagccggaggcatccctgtgctgggcagcctggtgaacaccgtcctgaagcacatcatctggctgaaggtcatcacagctaacatcctccagctgcaggtgaagccctcggccaatgaccaggagctgctagtcaagatccccctggacatggtggctggattcaacacgcccctggtcaagaccatcgtggagttccacatgacgactgaggcccaagccaccatccgcatggacaccagtgcaagtggccccacccgcctggtcctcagtgactgtgccaccagccatgggagcctgcgcatccaactgctgcataagctctccttcctggtgaacgccttagctaagcaggtcatgaacctcctagtgccatccatgccaaggtggcccaactgatcgtgctggaagtgtttccctccagtgaagccctccgccctttgttcaccctgggcatcgaagccagctcggaagctcagttttacaccaaaggtgaccaacttatactcaacttgaataacatcagctctgatcggatccagctgatgaactctgggattggctggttccaacctgatgttctgaaaaacatcatcactgagatcatccactccatcctgctgccgaaccagaatggcaaattaagatctggggtcccagtgtcattggtgaaggccttgggattcgaggcagctgagtcctcactgaccaaggatgcccttgtgcttactccagcctccttgtggaaacccagctctcctgtctcccagtgaagacttggatggcagccatcagggaaggctgggtcccagctgggagtatgggtgtgagctctatagaccatccctytctgcaatcaataaacacttgcctgtgaaaaaaaaaaaaaaaaaaaaaaaaaaaaaaaaaa

SEQ ID NO: 16 - DNA, 2374 bp, Homo sapiens
  misc_feature (556)..(556): n equals a,t,g, or c
  misc_feature (2344)..(2344): n equals a,t,g, or c
  misc_feature (2346)..(2346): n equals a,t,g, or c
gatcccaccacaacttaatgttaacattttaaattatttctttttttttcatacatatgcatagacaattactgggtttttgttttsttttttgtttttttttcaagcgacattgtgattgtattcttttataccttattgggtttgtwtttttacttaccatggtaaaaatccatttgagtgagcattcttgagtggttttgcattgtgtcttcacacagttgtaccataattraagctgcttttggccttgctctggtaaagcagtgtagcacacactcttaatttctaaggaagtgtagcgttcccttgatgaatcrggagagagatcatgaacttggtgtatgaggtacwctggtctgtcttttcaagctggggtaagtaggcatctgcaactaccagtcatatattttgtaacccactggcccgtgtgtgccctgattgctgaggctagacagatccatcagggcttagacagttagtgagggtcctgggagtaggcgaagggaagtccagttaatgtgtgaagctgctgggaattgtgtagttggcaganatttgagcaggtaaagcttccgatgtggaccaagtacaagtactaagatcacggcacatcctctaaaaggaagtcagatatttgggactgtccaggaaatctgggagatagtgtgatggtggcatagctctttctcatctgacactttttatgcttactcagagtacgaatgccaagtattgagacaatacagaataatatttgaattgagatattcctagaaagacaggtcaacatggctcttggtcaagaatgacttagagttccttgcctagtgctcggctggcttcatgtcatagttgaggctgggtccacaggtgggataagattccaccaaagctcaccaggctggtactgaccccagagtgtctcccaggccctaccttattttagcattcttttgaattgagtttcagaggtgattcagtagtaaatgtatggggagaagaattagaaaaacccatctctttttaagcagtcatcattcttaaacatctgaattgttttacaacagagtcagcaaacctttctagcatttctaaaagatggcagtttcttggagaccacatctttgcaaggcagtattttcaaaatataaaatagcccccaaaccaaacctttaaacatgaagggcaaatgggtaaagacttaatattctttttgtgtcaagtatacttaatgtaaatctagttgcttgtgaagtagtaatagtaatagctcctattattttgagcactgactatatgtgctcagcctctgtgcttggatctgacatcactatctcatttccttctctcagcagttctggaaggagtacctaccctgggtatgctttgcccagggtcacagaagttactgaattagagcagggattcaccccaagtgtaaaaactcaagagctcctgcacttaggggtttacttcactaatcatctaacctcatttattatgcttaaggctttttctcagctgacctgactttgctttaggtcattcttttttatgccagcactgtttgaaagtgcatgtcaagcggctagctccacatttggtcttcgaaagggaaacgcatgcagttaaaacgtaatgtacatgatggaattgggaggatcatagtctcagtttcccccccyctttctcccatctaggagacctccrtggactgcagcaaaattaaaaataaagcacagacaacagaattattcttcactgagagagtttaatatgcgtttctaacaccatctatacttgctttgttgttcttgaggtcatcaacacacattctggttattccagagctagaagctcttctggttgctaactcagttataagaagatgaaagacataactagmcttacgtatttcagtagtttgcyctttaatttttcccytacycytagtttccaggcgacctcccaagaagggtatcagtcgactggataaacagatgagaaagttcacagatataaggaaaaaaagcagatcygcacacgcagtgaaaatcagcattgagggcaacaaaatgccattgtgaccttgccyggaatgtgtccccatctctactctaagaaatgcgcaatggactctttggagaaagaagatattttaaaacatttttagtgtgtctgtaaatggttcagcgtgtatcagatgttgtcataggactcacatttctctcagttatatttaaaaccgttgtgtactttgtacaaaggaatactagtcatacttctataaactttacacaataaaatttcattctggtwaaaaaaaaaaaaaggggggccncnctaaaaaaccaagcttactttcccttgc

SEQ ID NO: 17 - DNA, 1595 bp, Homo sapiens
ggcacgagccggttattttagaactagagttgagatgaatatgacacttcataattacactcactacatttttcacaaattattttttaatgctgaaaagagtaattttacttgttgagatgtttattcattttctaatctatgctaaaagcttttatcataagtcttgggaacagttgtcatttacacattacttactgcagatatcttgactaaatcaggagggaggtgtttaatcatttgatatgtatagttgacactcaggaatagtaatgcctaaaatttacagtggatgaggtctgtttcaagtttaattctttttaaaaatgttttacttatttttaaatcactttgaaaaaattgacctccagaatgctgttttatgaaattggcaaataaatgaaggtattcaatttttgaggaagaatgacattgccacaaaatacctttttgtgacacctattaaaccactatgaaaataacttttcaggatctatttcctatgtggaattctttcaaatgctttcttcacggaaatgttttctcactcttcgttttgttccccttacttacatgtttctcttttccttatactgtgaactctggaacaaaactagattgggttggttggttggttggttggttcttcttggagtttatgtatatcaacaaaggatttgaggtcacttctgagaataatatatcaaaaagggtactggttagagaaaatataagaataaaatccagcccagagagagtactaagaatgtaaatgtgagtaaaaagccagttttgaattctatttacgtgacagtgatgcatgctgtcatttaattctcacaaaaactctcgttatatattttatcctcattttgtagatgaggatagcaggcttagaaggatttggtaatttactaatgtcatgatagggatttaaatctggaattgaagtaattgtgtctcactactctaagctaattgaacatcagacattaagagagatgatccttattgaagtaaaccagttcctaaaggatccttgtagtatacatacttgggaatcctgttcagagtaatttttaggaagtaggtacacagtagtaagtcttctgttgcctcagttggccatagatggaattctgtgtttgccactcattagaaatttaggaattttaggcagggcacggtggctcacacctgtaatcccagcactttgggaggccgaggcgggcagatcacctgaagtcaggagttcaagaccagcctgaccaacatggggaaaccccgtctctactaaaaatacaaaattagccgggcgtggtggtgcatacctgtaatcccagctactcgagaggccgaggcgggtgaatcacttgaggccagaagttcaagaccagcctggccaacatggcaaaactccgtctctactaaaaatacaaaaattagccaggtgtggtaacgcagacctgtaatcccagctactcgaatcaggagaatcacttgaacccaggaggcagaggttgtcagtgagtccgagatcgcactctagcctgggtgacagagtgagactctgtctaaaaaaaaaaaaaaaaaaa

SEQ ID NO: 18 - DNA, 1287 bp, Homo sapiens
  misc_feature (1188)..(1188): n equals a,t,g, or c
  misc_feature (1202)..(1202): n equals a,t,g, or c
  misc_feature (1230)..(1230): n equals a,t,g, or c
  misc_feature (1264)..(1264): n equals a,t,g, or c
  misc_feature (1277)..(1277): n equals a,t,g, or c
  misc_feature (1282)..(1282): n equals a,t,g, or c
aattcggcacgagaattttttttggtgatggcatgttcagaatcttggatccctaagttcaatatattggacatatttaggaactctggaaattatgttgttttcacatatctagtaacttactagatgaatcagtagatttcattaaagtatatctaataacagataattatgatgtacttctgggttgacatgcatgtctctcattatcagctatcagtattagtgtcatgctttggagacagttatcttttgaaggttttggggttcttatgaacctcatttttcccaggaagtttctgtaattcctcctatgcctattcttgtcttttctatctgcttgcagtgtacgttatttagatcagaggcaattatttttcaggaagaaagaaatcatcaagtgacactcctaaaggcagtaaagacaaaatttcagtctggaaccggtctcagaakgcctgtattagaatatgcaaagtccatccaaattatatccaaatatacttgtggcacagtgctaccagtttttaaaatgagacgttactatgtagggcagaagtgccaatgaggagagagaaggagctgttcagtttgccctccagccgccacctccttctattattggctgaatgaattagtgcaaaattagtagccaaaagggtagacagtgtgaatggaagggaggagaaggacagaaactttaatctccaggaaagcttatttatcctttaaaaaatggaaagttgggcaggcgcagtggctcacgcctgtaatgccagcactttgggaggccgaggcgggcagatcacgaggtcaggagatcgagaccatcctggctaacacagtgaaaccctgtctgtactaaaaaaaaaaaaatagaaaaagccaggcgtggtggcaggcgcctgtagtcccagctactcgggaggctgtggcaggagaatggtgtgaacctgggaggcggagcttgcagtgagccgagatcgcaccactgcactccagcctgggcaacagagcaagactccgcctcaaaaaaaaaaaaggaaagttgagtgtattccatgtacctgaacatgctatttaaaactgtgggctactttcagaatgtagactaatgkgktctcgaccattggaatgaatgagaatttgkatttgataggaaagtcagaaagtcctcgagagtctttntaaaaccgggccgngggccccatcgaatttttcaacccgggntgggggtacccaggtaaagtggtaccccaaattnggcccctataagnggagncggaa

SEQ ID NO: 19 - DNA, 1396 bp, Homo sapiens
  misc_feature (668)..(668): n equals a,t,g, or c
  misc_feature (739)..(739): n equals a,t,g, or c
  misc_feature (751)..(751): n equals a,t,g, or c
gctggtaaccaggtggaaccatttcacgtgtccctccccagctgcctcagtccccttccccacctgggccacagcatgggggttccctcacccaccgcctggccctctcttgcctcgttccacactcagaaaaaagcaaggatcagacaagaagaagagtccccacccctcccgtccccgcaggagctggcgttctctgcgctaagggtgttttttagagtgatgttttttctcctctgtctcgttgccctggagatcaaagggttcactttctcagcgaggggtgccagggacagatttctaaacaagtctggaccgcagccaggaaaaaagatgaaaacaacacactgtaaacagcctctattcagcaaacctggtcaggtcagaggggctytgaggaaagcaagagggaggcaggaggagagggaagcggtggggatgtggggggggcgggggcacagttatcctgaatacataaaaacaagtgaggtcactgaggtcagggatagtcccaaacatccccaagtccagcctttcctgacaaccagggttacatgcagagtcccaggccatctgcaggttttggaggccctgtgcggggcctgggggtctatgtttaaacacgcccttgtggtggtccaagtycccagaascaggggaagggcgantctgggctctgaatggcargtggggcagctccamctcatcctcctacatggcacccagcactgggctgcangcytggtccccnacttgccgcaggaatcaatcctgccagctcagagccsccgtgtgacaaacaccccaggaacagaggagacatgagaaagggactcaccagcccactgcccaggatgtagaagtcgtcgcaggagaagatggtgccggggtaggaggagaagaccagcttgttgccgggaaccagcgggtagtcccctgtgcaggcagagcgagccagggatgctggtcagacaggcacaggtggaggcccctgcaccctacctaacaagacacaggcacaggggcacaggcaggcctycgaggaagcccccactgtgtcctttttgtcatttagcaaatgaggtcattgggcatataaaagtgcatatacgtgcaagtaaaaataaaagctagcagcaaaacttatatagttggscctycatgtccgtgggttccacatccttggattcaatsgamtggggaccaaaaatactaggaaaaaaacatgattaaaaagaaacaacacagctgggtgcagtggytsacacctgtaatccctgcactttgggaggccaaggcaggcggatcacgaggtcaggagaccaagaccatcctggctaacacggtgaaacccgtctctactaaaaatacaaaaaaaaaaaaaaagggcggccgc

SEQ ID NO: 20 - DNA, 1277 bp, Homo sapiens
  misc_feature (1207)..(1207): n equals a,t,g, or c
  misc_feature (1272)..(1272): n equals a,t,g, or c
cgtttattcagcagaacatcagcttcctgctgggctacagcatccctgtgggctgtgtgggcctggcatttttcatcttcctctttgccacccccgtcttcatcaccaagcccccgatgggcagccaagtgtcctctatgcttaagctcgctctccaaaactgctgcccccagctgtggcaacgacactcggccagagaccgtcaatgtgcccgcgtgctggccgacgagaggtctccccagccaggggcttccccgcaagaggacatcgccaacttccaggtgctggtgaagatcttgcccgtcatggtgaccctggtgccctactggatggtctacttccagatgcagtccacctatgtcctgcarggtcttcacctccacatcccaaacattttcccagccaacccggccaacatctctgtggccctgagagcccagggcagcagctacacgatcccggaagcctggctcctcctggccaatgttgtggtggtgctgattctggtccctctgaaggaccgcttgatcgaccctttactgctgcggtgcaagctgcttccctctgctctgcagaagatggcgctggggatgttctttggttttacctccgtcattgtggcaggagtcctggagatggagcgcttacactacatccaccacaacgagaccgtgtcccagcagattggggaggtcctgtacaacgcggcaccactgtccatctggtggcagatccctcagtacctgctcattgggatcagtgagatctttgccagcatcccaggcctggagtttgcctactcagaggccccgcgctccatgcagggcgccatcatgggcatcttcttctgcctgtcgggggtgggctcactgttgggctccagcctagtggcactgctgtccttgcccgggggctggctgcactgccccaaggactttgggaacatcaacaattgccggatggacctctacttcttcctgctggctggcattcaggccgtcacggctctcctatttgtctggatcgctggacgctatgagagggcgtcccagggcccagcctcccacagccgtttcagcagggacaggggctgaacaggccctattccagcccccttgcttcactctaccggacagacggcagcagtcccagctctggtttccttctcggtttattctgttagaatgaaatggttcccataaataangggcatgagcccttcctcaaaaaaaaaaaaaaaaaaaaaaaaaaaaaaaaaaaaaaaaaaaaaanaaaaa

SEQ ID NO: 21 - DNA, 1781 bp, Homo sapiens
  misc_feature (1494)..(1494): n equals a,t,g, or c
  misc_feature (1496)..(1496): n equals a,t,g, or c
gctgggtgccatggcggcagcggcggtgacaggccagcggctgagaaccgcggcggccgaggaggcctcgaggccgcagtgggcgccgccagaccactgccaggctcaggcggcggccgggctgggcgacggcgaggacgcaccggtgcgtccgctgtgcaagccccgcggcatctgctcgcgcgcctacttcctggtgctgatggtgttcgtgcacctgtacctgggtaacgtgctggcgctgctgctcttcgtgcactacagcaacggcgacgaaagcagcgatcccgggccccaacaccgtgcccagggccccgggcccgagcccaccttaggtcccctcacccggctggagggcatcaaggtggggcacgagcgtaaggtccagctggtcaccgacagggatcacttcatccgaaccctcagcctcaagccgctgctcttcgaaatccccggcttcctgactgatgaagagtgtcggctcatcatccatctggcgcagatgaaggggttacagcgcascagatcctgcctactgaagagtatgaagaggcaatgagcactatgcaggtcagccagctggacctcttccggctgctggaccagaaccgtgatgggcaccttcagctccgtgaggttctggcccagactcgcctgggaaatggatggtggatgactccagagagcattcaggagatgtacgccgcgatcaaggctgaccctgatggtgacggagtgctgagtctgcaggagttctccaacatggaccttcgggacttccacaagtacatgaggagccacaaggcagagtccagtgagctggtgcggaacagccaccatacctggctctaccagggtgagggtgcccaccacatcatgcgtgccatccgccagagggtgctgcgcctcactcgcctgtcgcctgagatcgtggagctcagcgagccgctgcaggttgttcgatatggtgaggggggccactaccatgcccacgtggacagtgggcctgtgtacccagagaccatctgctcccataccaagctggtagccaacgagtctgtacccttcgagacctcctgccgctacatgacagtgctgttttatttgaacaacgtcactggtgggggcgagactgttttccctgtagcagataacagaacctacgatgaaatgagtctgattcaggatgacgtggacctccgtgacacacggaggcactgtgacaagggaaacctgcgtgtcaagccccaacagggcacagcagtcttctggtacaactacctgcctgatgggcaaggttgggtgggtgacgtagacgactactcgctgcacgggggctgcctggtcacgcgcggcaccaagtggattgccaacaactggattaatgtggaccccagccgagcgcggcaagcgctgttccaacaggagatggcccgccttgcccgagaagggggcaccgactcacagcccgagtgggctctggaccgggcctancncgatgcgcgcgtggaactctgagggaagagttagccccggttcccagccgcgggtcgccagttgcccaagatcaggggtccggctgtccttctgtcctgctgcagactaaaggtctggccaatgtcttgccccaccccgccagccgcgatacggcgcagttcctatattcatgttatttattgtgtactgactccatctgccccgtcaaataaaaaaccacaaggttcgaaaaaaaaaaaaaaaaaaattggggggggggcccggtaacccatttggccctttag

SEQ ID NO: 22 - DNA, 1491 bp, Homo sapiens
  misc_feature (1425)..(1426): n equals a,t,g, or c
ggaagtgtaggtacagattcaggtcatagaaaggcccatatgtcccaatattatttytyttacagagaaaacagatgaaattracaattttttttktytttccacagaccatcaccggcctcctgcagaktttgatgtccaggcaagtagaggatgtggctttccttccccttcctcatcccgtcttctctttttcctttttctttccattggtttaagtagatcattgtgcaaacattgcgggcaaggggagagaaggcagtggtctcagctaggtcctcaccctcagctgctgctcccagacagaagctgacttgagtgctggccagagaatcaggaaccagtcacttcccacgaaagcaggacagagacaccgcctgtttcagtcccaaagagctggccagaacggtggggcgtgtgtggggaaaatggtgtgatgctgggctggcttgggaccctgtgaggggagggaacggaagcaaaagcttgatgttcttggctccacttgggaaactgaaaccagccttctctgtggtttactggcccagaactgaagtatctccattcccactcaggattgcagggtgggccagggggtgcagctcagctgtgtccaagaataggctctcaggagaacgggctgggctctctcagccgagggctgggtcagaacttcaggaaatctaagtcctggactcgttagccccaagctggggtgggtcccatgctgtgctggcctctggagggtggggcaraaagcctgagcatatggcgagcttgtggtctccttgaaggaggagaggcgcactcctggaccagccagagagccagaggtggctgacggtgttctcacctgaacsgytacccatgtgttgcacaggtgtccccagtttgggacccattctgcactctgcatctcactcctctattctacctccttacctcaaaacaactccgcttttcctcttgaatctctgatttcatgaatgctcccccatccatcccgaggcgaggaatcttgcactgtctttggaaggaaaggaaaggatgggagaggggctggaagcattggctagtagatgatcgaggctttctataccaccaccaaggtgtgtattttctcatcatcctggttgtgtcaggctgtccctagagatcaccctgacctcagtgtttaagaagaagggccagatgcagtggctcatgcctgtaatcctagcactttggaaggccgaggcaggcagatcacctgaggtcaggagctcgaggccagcctggccaacaaggagaaaccctgtctctactaaaaatacaaaaattagccaggcatggtggtaagcacctataaccccagctacttgggggctgagacaggagaattgcttgaacctgggaggcagaggttgcagtgagccgagaccacgnngttgcactccagcctgggcaacaagagtgaaactctgtctcaaaaaaaaaaaaaaaaaactcgag

SEQ ID NO: 23 - DNA, 1839 bp, Homo sapiens
aattcggcacgagtgcaggtcgactctagaggatccccgctaagaagctagggctattggtcttcccatacacacatcagaactgaggcaccatgcaagggggccagagacctcatctcctcttgctgctgttggctgtctgcctgggggcccagagccgcaaccaagaggagcgtctgcttgcggacctgatgcgaaactacgacccccacctgcggccggctgagcgcgactcagatgtggtcaatgtcagcctgaagcttaccttgaccaacctcatctccctgaatgaacgagaggaggccctcacaactaacgtctggatagagatgcaatggtgcgactatcgcctgcgctgggacccaaaagactacgaaggcctgtggatattgagggtgccatctactatggtctggcggccagatatcgtcctggagaacaatgtggacggtgtcttcgaggtggctctctactgcaatgtcctcgtgtcccccgacggttgtatctactggctgccgcctgccatcttccgctcctcctgctccatctctgtcacctacttccccttcgattggcagaactgttccctcatcttccaatcccagacttacagcaccagtgagatcaacttgcagctgagccaggargatgggcaagccattgagtggatcttcattgacccggaggctttcacagagaatgggragtggsccatccggcaccgaccggytaaaatgctcctggactccgtggctcctgcagagraggcgggccaccagaaggtggtgttctacctgcttatccagcgcaagcccctcttctacgtcatcaacatcatcgccccctgtgtgctcatctcctcagtcgccatcctcatctacttccttcctgctaaggcgggcggccagaaatgcacagtggccaccaacgtgctcctggcccagactgtcttccttttccttgtggctaagaaggtgcctgagacctcccaggcagtgccactcatcagcaagtacctgaccttcctcatggtggtgaccatcctcatcgtcgtgaactctgtggtcgtgctcaatgtgtccttgcggtccccccacacacactccatggcccgtggggtccgcaaggtgttcctgaggctcctgccccagctgttacggatgcatgtgcgcccactagctccagctgctgtccaggatgcccggttccgactccagaatggctcttcctcagggtggcccatcatggctcgagaggaaggggacctctgtctgcctcgaagcgaactcctctttaggcaaaggcagcgcaatggattagtgcaggcagtattggagaagctagagaatggtccagaagtgaggcagagccaggagttctgtggcagcctgaagcaagcctccccagccatccaggcctgtgtggatgcctgtaacctcatggctcgtgcccgacgccagcagagtcactttgacagtgggaacgaggagtggttgctggtgggccgagtgctggaccgagtctgcttcctagccatgctctccctcttcatctgtggcactgctggcatcttcctcatggcccactacaaccaagtgcctgacctgccgttccccggagacccccgcccctacctgcctttgccagactgagccaaccaatccctcctgggccctggagtcagctatgagggccatgctgtttgtagagctgtatcccgtgttgatgctgagtgtgctcttggggaaatacccaaggcttcctgggagaagatagagaaataaagagacagaggggaaaaaaaaaaaaaaaaaaaaaaaaaaaaaaaaaaactcgtag

SEQ ID NO: 24 - DNA, 1384 bp, Homo sapiens
ggcacgagcagttattttcaaaatggctatggaaaacacgtaagttttaaaatatgccctctttctcgttttaaaaaattattactattgtccatacatgttactcttttcatctagatttatcatgtttctttggcctccagtctctggtgtttgcctaagctttattagagacaggtcatttctacctatgtgtcattttatctatgtcttgatcttatgtaattcaattgctctttaagattatgttctcttctcatgtttggtttatccattatccaaattttccatttctttaacctgttatcccttgactctttacagttctacctttttattcacttagtcttttaccctttttttattcgttcacccctttttgttgtttcaggtactccttacttatctccttagccttttcttcttcatcttctttcttacttttctcctacttctcattttacataatacttactttttgcttcagtcttcaaccattgtcaatcttgtttttccttatattccattttactttctgaactactctttaatctcctgttcaacactacctttccttcttttttatcccctcttatttacacggtgattacaacagtttggtatagtctgatttatctgattgtaaaattgatgagttggatgtaccaaaaatataaggaagctaaattcaaagaaggtaaaagatttgcttgtgtcacctagctggttaattttggcatatgcattgtttctctacatagtctatgtagtcaaacaggtttcatttagaaatcattccccataagaagggtttcaatttgatttgaacaggcagagatggaaaaaatttcctctctgataactactgctactgttgtataccagtagaaatataacagcagcacttaggttagaagaagctcattagctattcagaataaatttcatttttcttaatttttggtaatcatatctcagcctgttgaatttaacttaaactctgaaagaattttggttgccatttaatttttaggtttccttaatgatagggacctaataatttgttttaaaaaatttgtcttggctgggagcagtggctcatgcctgtaatcccagcactttaggaagccaacattggaggattgcatgagcccaggatttcgagaccagcctgggcaacacagtgaaacctcatctctacaaaaagttaaaaaattaaccaactgtggtgccacatgcctgtagtcccagctgcttgggaggatgaggtgagaggatttcttgagtccaggagtttgaggctgcagtgagctatgatcacactcctgctcttcagcctaggtgacacagcaggacactatctttgaaaaaaaaaaaaaaaaaa

SEQ ID NO: 25 - DNA, 1681 bp, Homo sapiens
tctctgggccaatatggcagcgcccagcaacaagacagagctggcctggagtccgcggctggccgcgtgagtaggtgattgtctgacaagcagaggcatgagctgggtccaggccaccctactggcccgaggcctctgtagggcctggggaggcacctgcggggccgccctcacaggaacctccatctctcaggtccctcgccggctccctcggggcctccactgcagcgcagctgcccatagctctgaacagtccctggttcccagcccaccggaaccccggcagaggcccaccaaggctctggtgccctttgaggacctgtttgggcaggcgcctggtggggaacgggacaaggcgagcttcctgcagacggtgcagaaatttgcggagcacagcgtgcgtaagcggggccacattgacttcatctacctggccctgcgcaagatgcgggagtatggtgtcgagcgggacctggctgtgtacaaccagctgctcaacatcttccccaaggaggtcttccggcctcgcaacatcatccagcgcatcttcgtccactaccctcggcagcaggagtgtgggattgctgtcctggagcagatggagaaccacggtgtgatgcccaacaaggagacggagttcctgctgattcagatctttggacgcaaaagctaccccatgctcaagttggtgcgcctgaagctgtggttccctcgattcatgaacgtcaaccccttcccagtgccccgggacctgccccaggaccctgtggagctggccatgtttggcctgcggcacatggagcctgaccttagtgccagggtcaccatctaccaggttcctttgcccaaagactcaacaggtgcagcagatcccccccagccccacatcgtaggaatccagagtcccgatcagcaggccgccctggcccgccacaatccagcccggcctgtctttgttgagggccccttctccctgtggctccgcaacaagtgtgtgtattaccacatcctcagagctgacttgctgcccccggaggagagggaagtggaagagacgccggaggagtggaacctctactacccgatgcagctggacctggagtatgtgaggagtggctgggacaactacgagtttgacatcaatgaagtggaggaaggccctgtcttcgccatgtgcatggcgggtgctcatgaccaggcgacgatggctaagtggatccagggcctgcaggagaccaacccaaccctggcccagatccccgtggtcttccgcctcgccgggtccacccgggagctccagacatcctctgcagggctggaggagccgcccctgcccgaggaccaccaggaagaagacgacaacctgcagcgacagcagcagggccagagctagtctgagccggcgcgagggcacgggctgtggcccgaggaggcggtggactgaaggcatgagatgccctttgagtgtacagcaaatcaatgttttcctgcttggggctctcttccctcatctctagcagtatggcatcccctccccaggatctcgggctgccagcgatgggcaggcgagacccctccagaatctgcaggcgcctctggttctccgaattcaaataaaaaggggcgggagcgctgttggttgtgcgcaaaaaaaaaaaaaaaaaaaaaaaaaaaaaaaaaa

SEQ ID NO: 26 - DNA, 1949 bp, Homo sapiens
  misc_feature (1130)..(1130): n equals a,t,g, or c
  misc_feature (1948)..(1948): n equals a,t,g, or c
gctacgccgtgggcacttcctcaacgacctgtgcgcgtccatgtggttcacctacctgctgctctacctgcactcggtgcgcgcctacagctcccgcggcgcgggctgctgctgctgctgggccaggtggcgacgggctgtgcacaccgctcgtgggctacgaggccgaccgcgccgccagctgctgcgcccgctacggcccgcgcaaggcctggcacctggtcggcaccgtctgcgtcctgctgtccttccccttcatcttcagcccctgcctgggctgtggggcggccacgccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtaygcagcggctgtgctgctgggtgctggctgtgccaccatcctcgtcacctcgctggccatgacggccgacctcatcggtccccacacgaacagcgganckttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctgggaccgtgatgcccggccctgactcctgacagcctcctgcacctgtgcaagggaactgtggggacgcacgaggatgccccccagggccttggggaaaagcccccactgcccctcactcttctctggacccccaccctccatcctcacccagctcccgggggtggggtcgggtgagggcagcagggatgcccgccagggacttgcaaggaccccctgggttttgagggtgtcccattctcaactctaatccatcccagccctctggaggatttggggtgcccctctcggcagggaacaggaagtaggaatcccagaagggtctgggggaaccctaaccctgagctcagtccagttcacccctcacctccagcctgggggtctccagacactgccagggccccctcaggacggctggagcctggaggagacagccacggggtggtgggctgggcctggaccccaccgtggtgggcagcagggctgcccggcaggcttggtggactctgctggcagcaaataaagagatgacggcaaaaaaaaaaaaaaaaaaaaaaaaaaaaaaaaaaaaaaaaaaaaaaaaaaaaggggggggggctagttnt

SEQ ID NO: 27 - DNA, 2286 bp, Homo sapiens
  misc_feature (2262)..(2262): n equals a,t,g, or c
  misc_feature (2264)..(2264): n equals a,t,g, or c
  misc_feature (2272)..(2272): n equals a,t,g, or c
  misc_feature (2278)..(2279): n equals a,t,g, or c
gctgatgtcgaggttcatcctgaaccacctggtgctggccattccactgagggtgctggtggttctgtgggccttcgtcttgggcctatccagggtcatgctggggcggcacaatgtcaccgacgtagcttttggcttttttctgggctacatgcagtacagcatcgtggactattgctggctctcaccccataatgctccggtcctctttttactgtggagtcaacgatgacaccatctcattgattatggcaccaggaagtctgaaggtttccacattcgatgatgtcaacctaaaccagcagccatcccgcttgtccctcttaggcatttcaggcttcctttgggatttcaggtgtcccatgatcttgatgtgctgctaggctggagcacacactggccattactgaacacagccatattagggaaagcaaaaaaacccaaaaaatcctctattgtatatttattcaacaactgtttatgtttccaggacaactgcaaagaaaacaagctgaggtggttatactgttgctgttaaaagttggtatcagtaagatttgtgttttgtgataatccctaaatcaacataccacttgtaaactgaacttcgagaaagaaacatgatgttcattctgtaaatatacatgcagacaggtcatgtactaatcctagtccttttcctgaggtagattttaaacagtatttttaaagtccaagacataggtttttctagtttattccctgaagatctgttgccacagttgggagatttcttcttaatcctgattttcttggtaagcttttttactttattatctctataatttattatctctatccatatttgtggatcgggtagtgggaaaagagattataatacttgtctttctctcctctccctccatccctcaaaagatctttatgcatttcccactactcccttactgtcttttagcattcagagaaaaagccaacttgcttaaagaggaatcacttaaaaggtaggcatatctaagatgctcatagaagaggaagaatgggacatggccccatgcttatttttgtttacaacgtaacatggcatgagagagggcagagaaactaagttgctggggaaagttagaggaactgaaagtttgggaataggctgaccacatattatgccagtgaccagtatgacaggagatggggccctgctgccagtcatctccactgaataaagaataatgctcctctttcagggtaataaagtggggaaaaggaacgtcttctcaatgcaagaacataagctttctcgtatatacctgtatgctacagtttttcacatggaattccgttttctgaggtacagcacattttaggtaacagtatttaacttgaaattcatcatgggagtctgctgctataccaggcacaagataaaactccaaaatttctgtttacattgacctttacatttaaagctgttcatccatggtgcctccccaaatcataagaccaaagaccaccaaacgcagggtggactctgctcattattctttgacccagaaagactggagaaggtatgtgctttaagtgctgctctacctgaaaagaaatcctttaaattacctatggaagtgatgtcctcagataatcttaatgactattttggcatttataaatagaaatgattatggactttgatctgccatacggaggttcggaacctggagaayggctgtgataagtaggttttgattgagtgaaagcatgagcttgttcagagtgaggggcatagtgaaaaaggaacagccatgcctcawaatcaaatcatttgcrttcccacagcatcctgaataccgactacctcttcacttgctaaagcagctaaactgtgaagctctaagtggtttgggtttgttgtttaaccttagcgagatcctttaactgcagcaatattcaagccagatatttggaagcaaatgatatttcctcttgcagtgtccacaaatctgaatattaggggcatgaaattaggcttaccatctgatttgtaattacaattttggaattctctgttttagttgctgaggcctgagttttctggctcttaaagcatagatcatttcacctgatgtttttgaagcatcctaagtacagtagagtagaaaactgatttctttgttaattgtacactgaataatgccttttaaaaatcaaaataaaattaacaaataatggtgaaaaaaaaaaaaaaaaaaaaaaactcgagggggggcncnaaaacaantcgacnnatagtga

SEQ ID NO: 28 - DNA, 530 bp, Homo sapiens
ccacgcgtccgaaaattttttcaatattttttattaatctttttataaaatgaaaagaaactcctatgatcgattaaggaaggtggttatggctgggtggttcaggggtttttttgggtttctttttttttttctttgtctttttaaccttaagctgtttaagttgaagcattctcagatgtttggggggaaacatcctcttaaaatgggtccttgtgcttgccttctggggaggcggtcctgagcaggtgaatcataaggcatttatgcatatgttatatgcggactgcacccacctctcccccccagcctttgcctcttgggttgttgtgctgctttccccttactttgctacatttctatagttaagttggttttacttgaatgattcatgtttagggggaaaatgaaaatctcccttaaaatttgtttcaactcctcctgcaaataaaataaatgaagtggcagatgtaaaaaaaaaaaaaaaaaaaaaaaaaaaaaaaaaaaaaaaaaaaaaaaaaaaaaaaaaa

SEQ ID NO: 29 - DNA, 1296 bp, Homo sapiens
cttcatcagctgcgacctcctcaccgctttcctcttataccgcctgctgctgctgaaggggctggggcgccgccaggttgtggctactgtgtcttttggcttcttaaccccctgcctatggcaktatccagccgcggtaatgcggactctattgtcgcctccctggtcctgatggtcctctacttgataaagaaaagactcgtcgcgtgtgcagctgtattctatggtttcgyggtgcatatgaagatatatccagtgacttacatccttcccataaccctccacctgcttccagatcgcgacaatgacaaaagcctccgtcaattccggtacactttccaggcttgtttgtacgagctcctgaaaaagctgtgtaatcgggctgtgctgctgtttgtagcagttgctggactcacgttttttgccctgagctttggtttttactatgagtacggctgggaatttttggaacacacctacttttatcacctgactaggcgggatatccgtcacaacttttctccgtacttctacatgctgtatttgactgcagagagcaagtggagtttttccctgggaattgctgcattcctgccacagctcatcttgctttcagctgtgtctttcgcctattacagagacctcgttttttgttgttttcttcatacgtccatttttgtgacttttaacaaagtctgcacctcccagtactttctttgggtacctctggcttactgcctcttgtgatgccactagtcagaatgccttggaaaagagctgtagttctcctaatgttatggtttatagggcaggccatgtggctggctcctgcctatgttctagagtttcaaggaaagaacacctttctgtttatttggttagctggtttgttctttcttcttatcaattgttccatcctgattcaaattatttcccattacaaagaagaacccctgacagagagaatcaaatatgactagtgtatgttccacaccctctgctactgtgttacattctgattgtcttgtatggaccagaagagagctttgggacattttttctgaacattctaagcattctagtgaaagttcccatgttccaacagaacttaaaagcaatgtttgccttatatataaaagggacacaataattgaggtccaccttctaggaaatcctaggactcgtttatttgggacatggtgggaataaaggtcacatattggaaaaaaaaaaaaaaaaaaaaaaaaaaaaaaaaaaaaaaaaaaaaaaaaaaaaaaaaaaaaaaaaaaaaaaaaa

SEQ ID NO: 30 - DNA, 1979 bp, Homo sapiens
  misc_feature (968)..(968): n equals a,t,g, or c
gctttgccagggctgagccgggctgcctggtgccctcaccgcccccgccawacaccaccatgcwgactcccggcctgcggaactcgtagtgcagcccctgtcgcctccccggcccctgctatcccacgcaggactggcttcggccgccggggccagcagcttgcracgtgtccctggggaggcggaatcgctgtgcgccctgagcccgggctcagcccttcgctttccagctgcgtcctgctcccggccgsccagggagcccagtggcgatgagggcactgctggcgctttgccttctccttggctggctgcgctggggcccggcgggcgcccagcagtccggagagtactgccacggctgggtggacgtgcagggcaactaccacgagggcttccagtgcccagaggacttcgacacgctggacgctaccatctgctgcggctcctgcgcgctccgctactgttgcgccgcggccgacgccaggctggagcagggcggctgcaccaacgaccgccgcgaactggagcacccaggcatcactgcgcagcctgtctacgtcccctttctcatcgtcggctccatcttcattgcgttcatcatcctgggctctgtagtggctatttattgttgcacctgtttgagacccaaggagccctcgcagcagccaatccgcttctcactccgcagctatcagacagagaccctgcccatgatcctgacctccaccagccccagggcaccctcccggcagtccagcacagccacgagctycagcttcacaggcggctycatccgcaggttcttctcagccatctggtttcctggtgtcaccccagtatttcgcttacccccttcagcagragcccccactggctgggaagagctgtccagactttcagttccagktgacacgcccaggccatgaatycacaactcagtcagatggcagacaggtggagccctgctnccattgccacatgcaattctgagaaaatttcccttgtaactgatcagtgtcwtggaggagcatgctaggaaaacacagcaccttctaatttgaaagttcctgtctccaatcacagaaaggctaaaccagagaactgtttctggttttgcaaacatgtgatcattacatttcaatctatgctacttttattcaaaatatgcagcagtttgactttaaagttgcaaactggctaaaaacgttttactggacattcagctatattgcttagaaaagggctacatgtttctttttcatataagttgttcattgagttatgataggaatatattcataaataagcaaagaaaaatacctaattgtaattatcaaaggttcacttaaaaaattaactattaggtaaacttaagggggcagtgaaaaatctatttatgatttcgggagtaacctaaccatgaataatattagcatwatgagamcatttmctttttaaataaatamctaaatttkgtttacaaymggagttttyccagaatacaaggttycaataatcacatgaggagtttaaagttttaaatatatactcagacattcattgtaacacagagtgtatgtaaaatcatttcccccactcactggagggagtatttattgcagactttttgttcagcaacatttagtgtttcagtgaaagttggacagttggggcttaaaacatttatttgtaaaatgagctatgttcaaatgtaaatatttgtaatttaatgtatttaccmcattgactgtactaattatttagtagtcatactgtaatttttatgttaataataactggagttcaaagtctagctattggtataatcatctaatattatatatatctccagtgcccctgaattttatgtttgatgactatatatttgggcatatatcttgttggattagaataaataaaacactttatattttcatgaactctaaaaaaaaaaaaaaaaaaaaaaaaaaaaaaaaaaa

SEQ ID NO: 31 - DNA, 1274 bp, Homo sapiens
gcccacgcgtccgctgttgctcaaaggaaataggagttggtgtgcttgtgaccaaggggttacacttmcagcttttaaaattctcctttacatgtgctcagtgttttgktttgtgttttggtttctgttttttattttaattcccacattgggcacaagaatcagaatatggatagctagtttaagaaacttttgtgggtgcactgtagcatagatgacagaatttgatgttccccccatctccaattcagttcagggcattccacagttaaacagaaatgggaacgtggggctcttataaatgaatgggcgctcacagttttggttttcagctcttcatgtctgtaagtgtgctttggggraggctatgtctgtatggtcgattctcagttatcacatttgcctctcctcccactaccttcatgamcattcagtgctgttcgcactgcagttagagagaagggacggacagttggtgacactcagccacattgctacttttatctgttctggtaagaagttagatagatggtagattgaagcaattgggtagaattagttgggggaatatttatgagttgctgtgtttgttgattagttccatctctttcccattttaactgagaattgattatatatagctctaagtatataggtatttaaacaaccccacaagcggctgtatcagtaacatttattaattccactatagtgagggaggatttccattctaaataccttattttgagggatttataaaacttagttgtaaaagagaaagcccacatagtgggaataaattgcttcagccatttttagtatttgagagcactagggaagatgtttagtagctgtgtggatgccttttttcacaccctgtctattgaatgctgcatccattcacgaagttaaatgttacatgcagttagtccttaatgtggactggatctgtacttttgttttggattaaaacatttaaagatttttgaagtgcagctactccccacgtgcatttgmtacacataaaagtcatactgtgtgtgcacaaagagtacatggattttccagcataytgctttaaaaaattatataaactgttaaaatattaacacctcaggctacctgctgtattctgtcccattgacccctggaattggatttactgcaagtgattgataattcaattatgtggcttttcccctttaatcttgccatttaaattacagtagaaagacaaaatcaagtaaaataaagtgttagataatagaaagagt

SEQ ID NO: 32 - DNA, 1531 bp, Homo sapiens
tcaaaagactacttagtgacactataaaagttacgcctgcaggtaccggtccggaattcgcggccgcgtcgacgaagtgctgaccaattgccactggacatacttgaaacaaaataggaaaatggcagcaaactcttcaggacaagcattgcactctcgagaccctctcttaataaggacttccgggatcacgctgagcagcagcatattgcagcccaacagaaggcagctttgcagcatgctcatgcacattcatctggatacttcatcactcaagactctgcatttgggaaccttattcttcctgttttacctcgccttgacccagaatgaagaaaacatttgcgatggaaaagtgactttgtaatatcaaatgccaaagctactatcattcagtgctacatgaactgtgactttaagaattttggtgaactttgatattttttgtttgtctgaaagaaaggaatgtgtaagtgaaagctgaaagaagaataaccaggatgatgagagctgtggaagctgtatcgtccaaggaattgattatgtaccgtgactgtaacttttttgtaatgctgtttaactctcaatcagactgtgaactggatggtcacgaagtcattccccaactcctagcaagtttgactgaatatatcatgtccacagtagattttcaagaatcatttatagtacttaactttaaagaaacaaggctgcttttaaaaaatgaactaataggcttaaatcaattgcatccatatttgctgtttataggattgctatcagtataccttttgcgtttatagtcaacatgtatcatcctgaaatattctttctggacttataactacttccccctttttcactttaaaacaaacctcaagaataaattactaaccagtcttaaccatcttttataaacatatgctcttataaatgttgtgactagatgcaattaaaaataatagggaatgtggtaggtttttaatttgtacatcctcttatttagtgttaccacataaatgatgagtttgtgtggttctgttttccatttttgttctaactgaaaactttttggctggtcttgaactcttggcctcaagcagtcctctcgatcctcccaccttggcctcctaaagtgctgagattacaggtgtgagccactgcatctggcttacttattttgtctattgtctgttccactagtatgtaaagtcttagagagcaagaatttttgtttatttctttctcttcctcctttcctttcttcctcttttacttcgttcactactgtattccacataaaatatatttggcatatagtaggtgttcaatatgttgaaggaatgaaagaatttatagacttgagttgcaatataaaatgtatttttttttactgtgagttatggcaaaaaaagttttgaaagccgcttctaaataatgcagatgtcagtgctttgaccctggaataaaaactgaaatgacttagtgatttcaaaaaaaaaaaaaaaaaaaaaaaaaaaaaaaaaaaaaa

SEQ ID NO: 33 - DNA, 2090 bp, Homo sapiens
  misc_feature (967)..(967): n equals a,t,g, or c
atagggaaagctggtacgcctgcaggtaccggtccggaattcccgggtcgacccacgcgtccgagctgatgcccataattgtattgatcctcgtgtcattattaagccagttgatggtctctaatcctccttattccttatatcccagatctggaactgggcaaactattaaaatgcaaacagaaaacttgggtgttgtttattatgtcaacaaggacttcaaaaatgaatataaaggaatgttattacaaaaggtagaaaagagtgtggaggaagattatgtgactaatattcgaaataactgctggaaagaaagacaacaaaaaacagatatgcagtatgcagcaaaagtataccgtgatgatcgactccgaagaaggcagatgccttgagcatggacaactgtaaagaattagagcggcttaccagtctttataaaggaggatgaactggaatttttatttataccttttagcgtactctttattttttctgtaagtaagtttggtttcatcatgagggatgaaggaaaagatttgatactgaaaactaaactgaatagttggttcctgaaatcttggactgtttatgacctactggctcctttaaatagtaactgaaaactaaaatggaatattttagttaacgcttctacaagtattttcattttaaaagcttacatgattcctaactaaagtgtcatgagaaaggattatcacacctgtagcaatttccagttttagtgattctccattttttcccttgtcatgtaaatatttatggaatgatcattttgtgtacatacaggttactgcttttttatttaaattcttttagtgtttagctccatgagacacttcagtttaaattgatggaataaatgttatatgacacatttacattttccttatcaaggtgtcaaatatgtggactttaaacaatgaaactttttcaaaaagaaaaamcnaaaactttaactttgtgtaaaatcttatagtattatcagcttagagggaattgatatttttaatattgccgttatattccaaaatatatattgagataaatgaactggtgtagaatatcagtttgctatttagttttatgaattactatacatatacatgcatagaaatgaaatgctatactgataaattttaaagaaaatatgaggaaatggctataaatattaaactaaaagggtcttcaacagtaaagtgcagttatgtcatttaaaattccaatactttaaaggccaccaaattttgatgtatatgtccttgaagggctgctaaaatttatgaagaggactcacattttcccccatagaaatttgcagtttcttggtgatcatttaagcaggatccaaagaagttcctttacaaataagtaataagaaaaatgagtactaaaatacagctttgtgccttttaaccctatgccaactcctaaacatataagtagattacagtatacttatctgatcagagcatgayctgtttggccacatgcaagtgtgagcagaaatagagcagcacgtagaatagtaacttaaagcaagtcatcctttaaaaattctgagctaaaatctatttaccattgagtaattgaattaatcccataggaataagctccttgtaagtaaatccatgatatgaattagaaaaaaaaaacagctggaaattgaagtttttgatgcctgtatactggatatgaaactatttgatttctagtcttctgtgtttagcagttgtaatattttaatgattttgcttcatactcrgttaatggaacataaacatatctttgatacttctttgtgagtgagagaatgctagatagggtggctttgttctttgtttaagttttttttcctgaatgtagttaatttatggcatctgttgaataaaactgctaaaatgacctcttaaaaatgttctgttgtatccccttttccaggtgaatcaatagaaatgcctgattgaattagtaggttaaactaaacaacatactgtcataggaaaactggagagcttaaccaacttgctcttagaaatgttaccttaaaaaaaaaaaaaaagggcggccgc

SEQ ID NO: 34 - DNA, 1006 bp, Homo sapiens
gctcgtggcgctggaccgcatggagtacgtgcgcaccttccgcaagcgcgaggacctgcgcggccgcctgttttgggtggcgctggacctgctggacctgctggacatgcaggccagcctgtgggagccgccgcgctccgggctgccgctgtgggccgagggcctcaccttcttctactgctacatgctgctgctggtgctgccgtgcgtggcgctcagcgaggtcagcatgcagggcgagcacatagcgccgcagaagatgatgctgtacccggtgctcagcctcgccaccgtcaatgtggtggccgtgctggcgcgcgccgccaacatggcgctgttccgggacagccgtgtctcggccatcttcgtcggcaaaaacgtggtggcgctcgccaccaaggcctgcaccttcctggagtaccgccgccaggtgcgcgacttcccgccgcctgcgctatcactggagctgcagccgccacccccgcagcgcaactcggtgccgccgccgccgccgctgcacggcccgcctgggcgcccccacatgtcctcgcccacgcgtgaccccctggacacgtgacagggcccgcgcggcccccgacacgcccctggggcgcagagacaccgggttggcttggggcgcgcggtttgcatgggatggggtgggggcgggctcccctagggacaggtgcctcgagtgcccgtgcctggggtcccgcggccgcttcttcatctcaggaatctctcggaccgcggatcctcagcccccgctccaccagcccgccccagsgcgtgggtctgtttgggaggcctgggccggagcagagcagaggtgatccggcccctgcctgctgggccgcccgggttggaagggagggcagtgtgggcggagatctgctccttcggtgggggcctctggctcagatttggggccaaggaggcctctgtcattttaaagactcgtgtttacagttttgtaaaaaaaaaaaaaaaaaaaaaaaaactcgag

SEQ ID NO: 35 - DNA, 1787 bp, Homo sapiens
gcagtgttgcacttttctacaattttggaaaatcttggaaatcagatccagggattattaaagsracagaagagcaaaagaaaaagacaatagttgaacttgcagagacaggaagtctggacctcagtatattctgcagtacctgtttgatacgaaaaccggtgaggtccaaacattgtggtgtgtgcaaccgctgtatagcaaaatttgatcatcattgcccatgggtgggtaactgtgtaggtgcaggcaaccatagatattttatgggctacctattcttcttgctttttatgatctgctggatgatttatggttgtatatcttactggggactccactgtgagaccacttacaccaaggatggattttggacatacattactcagattgccacgtgttcaccttggatgttttggatgttcctgaacagtgttttccacttcatgtgggtggctgtattactcatgtgtcagatgtaccagatatcatgtttaggtattactacaaatgaaagaatgaatgccaggagatacaagcactttaaagtcacaacaacgtctattgaaagcccattcaaccatggatgtgtaagaaatattatagacttctttgaatttcgatgctgtggcctctttcgtcctgttatcgtggactggaccaggcagtatacaatagaatatgaccaaatatcaggatctgggtaccagctggtgtagcgacatcttatcctatgaagcatattgctgagtggtgcctgaaaattgtgtctgtccgtgtctttctcacactcgaatccacatcctttgaacaagagcatgctatgtgtagggctaawggtgaattttacagtctttttttcaacacttttattamcaaaagtaaacatggacagaacacactgcccatttctgggaagagtaaagatgataaaaaataattttaatggttcttaatgtggaaattcacaacatactcaacttttgggttttgttctcacagtatttttcacaaaaaaagggtaaacttattctattgacagacatggtgtactgatcagaaatgttcagttttaactaaaactaaatttatgttatttggctaaatgttatgatgcagtctagtacgagtattgcatctaattccaggagcattgttttaagttgattgactagttattatgtacatttcagaatgtacacataaatactgtgatgaaaatcatgtgattgggatctactgtgatgttgtcttcaarggcaggagaaaataatgttcacaataaaatgtgctaacaatgttttgtttctatcagctgttgcaatgctgatatatttctagttcagtgaaataatttgtagtaaccttactctgaggttttacggtctgataatgaagcacttgcatgagtatagtaagtcatgtttttttgttcaaatttaaaagccctgctaattgcatgacacaccacatagaatgtatactagcagatactatccagtgaagcataaattagaatttaatttgatgttcaaaaacagttccatttttaagggttaaggtggtattttcaagaaaaggcagaacaaataatgcaaaattctcagtaatagtgatacatggatatacttccttttaaattctcagctgcaaaataattgtagrcaaaatwatggcatttaactaaagatggagcatgatctgtgtacatagcacatgtgaataaaagaaaagctgacagtataaaaaaaaaaaaaaaaaaaaaaaaaaaaaaaaagggcggccgc

SEQ ID NO: 36 - DNA, 1201 bp, Homo sapiens
  misc_feature (29)..(29): n equals a,t,g, or c
  misc_feature (48)..(48): n equals a,t,g, or c
  misc_feature (63)..(63): n equals a,t,g, or c
  misc_feature (1201)..(1201): n equals a,t,g, or c
taggcttttgcaaaaagctttttaggtgncctatagaaggtacgcctncaggtaccggtccgnaattcccggtcgaccccacgcgtccgaaggaaactacttgagragggacccaactttccgctatcttttgggttcattccaaatagttttgtgccattgaaaaacttgaccttcaaaaaaatttgtttttcagaatagaacacaataggacagtgactgcacagttgtgaaaaaggaagagaatcattaaagaaaaagaaaaaagattttaagaccgttgaaatcaattatcaagaacgtcctaaaacacctatggctttgactttgttattgatccagattattttccttgcattggggaaaatatctttcatatttgtttgctgtaaagatggttttgcaagaataagtcatgaccaagacaaactgccaatacaaaagcccactgatactaattatataatgagaaaaaaatgtatccaactaggacacatatcttttgagttatttggactgaaagcttaagaaaacttggaaaattctattttgtgatctagtcaagccacagttatcaaaggctacattttcagtgtaagataaatggatgagtaaactcaaatatgtatcacgtgtgctttgtatcttaagatgtgtttccaagagcatctgaaattttgtttgtacatgtatcttgatcatttataaagccactgtgatctataaatcaagaaaatccattgtcataaccatttttaaaagtcaaaaattaagacatccttaattaaaaagtttcaaatctagacactaaatgtgtgtgaatgtacaaagaaaacaaaccattgcttatgctgttatatactagagaaattttgttttgcttgctgttttaacttgacagatgaaggactttagttgaacttcatattgtaagaactgttaataaaagttgtcaagtaaaaagcgctatatctaaaaagactttatgaacagttattctatcaacttttaaaggttttaaacctgcccagaaattaccttggtatctgaagtttccctctgtctcctcctctaattaagcttgttatttgtcatgcaccagcattggagataataaaatttcttgttctgtgtaaaaaaaaaaaaaaaaaaaaaaaaaaaaaaaaaaaaaaaaaaaaaaaaaaaaaaaaaaaaaaaaaan

SEQ ID NO: 37 - DNA, 1896 bp, Homo sapiens
  misc_feature (444)..(444): n equals a,t,g, or c
ctgcaggaattcggcacgagcggaaccggggccggctgctgtgcatgctggcgctgaccttcatgttcatggtgctggaggtggtggtgagccgggtgacctcgtcgctggcgatgctctccgactccttccacatgctgtcggacgtgctggcgctggtggtggcgctggtggccgagcgcttcgcccggcggacccacgccacccagaagaacacgttcggctggatccgagccgaggtaatgggggctctggtgaacgccatcttcctgactggcctctgtttcgccatcctgctggaggccatcgagcgcttcatcgagccgcacgagatgcagcagccgctggtggtccttggggtcggcgtggccgggctgctggtcaacgtgctggggctctgcctcttccaccatcacagcggcttcagccaggactccggccacngccactcgcacgggggtcacggccacggccacggcctccccaaggggcctcgcgttaagagcacccgccccgggagcagcgacatcaacgtggccccgggcgagcagggtcccgaccaggaggagaccaacaccctggtggccaataccagcaactccaacgggctgaaattggaccccgcagacccagaaaaccccagaagtggtgatacagtggaagtacaagtgaatggaaatcttgtcagagaacctgaccatatggaactggaagaagatagggctggacaacttaacatgcgtggagtttttctgcatgtccttggagatgccttgggttcagtgattgtagtagtaaatgccttagtcttttacttttcttggaaaggttgttctgaaggggatttttgtgtgaatccatgtttccctgacccctgcaagccatttgtagaaataattaatagtactcatgcatcagtttatgaggctggtccttgctgggtgctatatttagatccaactctttgtgttgtaatggtttgtatacttctttacacaacctayccattacttaaggaatctgctcttattcttctacaaactgttcctaaacaaattgatatcagaaatttgataaaagaacttcgaaatgttgaaggagttgaggaagttcatgaattacatgtttggcaacttgctggaagcagaatcattgccactgctcacataaaatgtgaagatccaacatcatacatggaggtggctaaamccattaaagacgtttttcataatcacggaattcacgctactaccattcagcctgaatttgctagtgtaggctctaaatcaagtgtagttccgtgtgaacttgcctgcagaacccagtgtgctttgaagcaatgttgtgggacactaccacaagccccttctggaaaggatgcagaaaagaccccagcagttagcatttcttgtttagaacttagtaacaatctagagaagaagcccaggaggactaaagctgaaaacatccctgctgttgtgatagagattaaaaacatgcccaaacaaacaacctgaatcatctttgtgagtcttgaaaaagatgtgatatttgacttttgctttaaactgcaagaggaaaaagactccactgaaattctaagtttgccaagtagtgtaattgaagtccttgtctggtcacacagtttaattctatttttgtaagaacataatgggactgcataacagagttctatattacaattttgtgattattagtacagagtacagctatgctgtgactgttttggaaagccagttttaacactatgttacatttttgtttaaagtaagttaaaccttatataacataatgacatttgatttctggatttttcccatgataaaaattagggggataaataaaattgttactggaatttctctgcaaaaaaaa

SEQ ID NO: 38 - DNA, 1152 bp, Homo sapiens
  misc_feature (1145)..(1145): n equals a,t,g, or c
agttccaggataaaaacagaccgtgtctcagtaactggccagaggatacggatgtcctctacatcgtgtctcagttctttgtagaagagtggcggaaatttgttagaaagcctacaagatgcagccctgtgtcatcagttgggaacagtgctcttttgtgtccccacgggggcctcatgtttacatttgcttccatgaccaaagaagattctaaacttatagctctcatatggcccagtgagtggcaaatgatacaaaagctctttgttgtggatcatgtaattaaaatcacgagaattgaagtgggagatgtaaacccttcagaaacacagtatatttctgagcccaaactctgtccagaatgcagagaaggcttattgtgtcagcagcagagggacctgcgtgaatacactcaagccaccatctatgtccataaagttgtggataataaaaaggtgatgaaggattcggctccggaactgaatgtgagtagttctgaaacagaggaggacaaggaagaagctaaaccagatggagaaaaagatccagattttaatcaaagcmatggtggaacaaagcggcaaaagatatcccatcaaaattatatagcctatcaaaagcaagttattcgccgaagtatgcgacatagaaaagttcgtggtgagaaagcacttctcgtttctgctaatcagacgttaaaagaattgaaaattcagatcatgcatgcattttcagttgctccttttgaccagaatttgtcaattgatggaaagattttaagtgatgactgtgccaccctaggcacccttggcgtcattcctgaatctgtcattttattgaaggctgatgaaccaattgcagattatgctgcaatggatgatgtcatgcaagtttgtatgccagaagaagggtttaaaggtactggtcttcttggacattaatctttgaatacttgctgactgctaagaaatgaccagaggggaagaggagtttgacatgttagggcattaaagcaaaggtggatttaagaattaaaccattacatgccccttccaaaaggcagaaatccattcaaacgtgactgtcccaaatgccttatgtcaaataaagcagattgcactgatggaaaaaaaaaaaaaaaaaanactcgag

SEQ ID NO: 39 - DNA, 1017 bp, Homo sapiens
  misc_feature (822)..(822): n equals a,t,g, or c
  misc_feature (994)..(994): n equals a,t,g, or c
gaacaaagttcagtgactgagagggctgagcggaggctgctgaaggggagaaaggagtgaggagctgctgggcagagagggactgtccggctcccagatgctgggcctcctggggagcacagccctcgtgggatggatcacaggtgctgctgtggcggtcctgctgctgctgctgctgctggccacctgccttttccacggacggcaggactgtgacgtggagaggaaccgtacagctgcagggggaaaccgagtccgccgggcccagccttggcccttccggcggcggggccacctgggaatctttcaccatcaccgtcatcctggccacgtatctcatgtgccgaatgtgggcctccaccaccaccaccacccccgccacamccctcaccaccwccaccaccaccaccacccccaccgccaccatccccgccacgctcgctgargctgctgtcgccggtgcctgtggacagcagctgcccctgccctcccatctgttcccaggacaagtggaccccatgtttccatgtggaaggatgcatctctggggtgaacgargggaacaatagactggggcttgctccagctgcatttgcatggcatgccccagtgtactatggcagcagagaatggaggaacactgggtctgcagtgctgaagggtttggggagtggagagcaagggtgctctttcggggctggacagcccgtcttgtgacagtgactcccagtgagccccagaaatgacaagcgtgtcttggcagagccagcacacaagtggatgtgaagtgcccgtcttgacctcctcatcaggctgctgcangcctctggcgggcagggcactgggagaggccctgagaatgtccttttggtttggagaaggcagtgtgaggctgcacagtcaattcatcggtgccttagtccaagaaaataaaaaccactaagaaaaaaaaaaaaaaaaaatgaccctcgagggggggcccggtacccaattngccctatgaagaggcgaacagga

SEQ ID NO: 40 - DNA, 1777 bp, Homo sapiens
ggcacgaggtccccgacgcgccccgcccaacccctacgatgaagagggcgtccgctggagggagccggctgctggcatgggtgctgtggctgcaggcctggcaggtggcagccccatgcccaggtgcctgcgtatgctacaatgagcccaaggtgacgacaagctgcccccagcagggcctgcaggctgtgcccgtgggcatccctgctgccagccagcgcatcttcctgcacggcaaccgcatctcgcatgtgccagctgccagcttccgtgcctgccgcaacctcaccatcctgtggctgcactcgaatgtgctggcccgaattgatgcggctgccttcactggcctggccctcctggagcagctggacctcagcgataatgcacagctccggtctgtggaccctgccacattccacggcctgggccgcctacacacgctgcacctggaccgctgcggcctgcaggagctgggcccggggctgttccgcggcctggctgccctgcagtacctctacctgcaggacaacgcgctgcaggcactgcctgatgacaccttccgcgacctgggcaacctcacacacctcttcctgcacggcaaccgcatctccagcgtgcccgagcgcgccttccgtgggctgcacagcctcgaccgtctcctactgcaccagaaccgcgtggcccatgtgcacccgcatgccttccgtgaccttggccgcctcatgacactctatctgtttgccaacaatctatcagcgctgcccactgaggccctggcccccctgcgtgccctgcagtacctgaggctcaacgacaacccctgggtgtgtgactgccgggcacgcccactctgggcctggctgcagaagttccgcggctcctcctccgaggtgccctgcagcctcccgcaacgcctggctggccgtgacctcaaacgcctagctgccaatgacctgcagggctgcgctgtggccaccggcccttaccatcccatctggaccggcagggccaccgatgaggagccgctggggcttcccaagtgctgccagccagatgccgctgacaaggcctcagtactggagcctggaagaccagcttcggcaggcaatgcgctgaagggacgcgtgccgcccggtgacagcccgccgggcaacggctctggcccacggcacatcaatgactcaccctttgggactctgcctggctctgctgagcccccggctcactgcagtgcggcccgagggctccgagccaccaggttccccacttcgggccctcgccggaggccaggctgttcacgcaagaaccgcacccgcagccactgccgtctgggccaggcaggcagcgggggtggcgggactggtgactcagaaggctcaggtgccctacccagcctcacctgcagcctcacccccctgggcctggcgctggtgctgtggacagtgcttgggccctgctgacccccagcggacacaagagcgtgctcagcagccaggtgtgtgtacatacggggtctctctccacgccgccaagccagccgggcggccgacccgtggggcaggccaggccaggtcctccctgatggacgcctgccgcccgccacccccatctccaccccatcatgtttacagggttcggcggcagcgtttgttccagaacgccgcctcccacccagatcgcggtatatagagatatgcattttattttacttgtgtaaaaatatcggacgacgtggaataaagagctcttttcttaaaaaaaaaaaaaaaaaactcga

SEQ ID NO: 41 - DNA, 1003 bp, Homo sapiens
  misc_feature (990)..(990): n equals a,t,g, or c
  misc_feature (1002)..(1002): n equals a,t,g, or c
aattcggcacgagttcctctcctcctgttttgctacattctcctcagtggcaaaaagtttcactctacctctgacagcatgtatattgcaccagtagctaacaaaaactggtctagtcaaaccaaatgggcacaaaagaaccaggataccaaaagttaagctcatacagctgcaaaccatatcacttcttggtaacaatgcagacctcataaacctaaagaagagaaagaaaagaaaacttttgttactttccttttttgcttgtcacttatatacaggctatgtgagaatataatttgtaggtataacacattaagaaaaagttatcttcattggatagaattgaatggtggtcgctgataggaatagggcgtcctctagctcttatctctgtctcttactcttttctctttctctttttctctgtcatgagactgtgtgtgacagggccacctgtctttttttttttcttaaatttttttttctttttatgtgtaggtgcatgtcttggggatttaaaaatttcaaggctggtttacttatgcaaagcatgcctacgtctggaatacttagggaaagaaagcgactccatgttgtccgaattcctcaagggacagaaaaaaaattggagactgttgaaatgcagatttgaagtaatttttttaaaatattattttgggttctgcgacattgtgaaaaattaaagttgttgtgcaatacttaattcagacatgtaccacaagttaatggtagactaacactggggggtggggtctaggcatcatgcttttgtcagcatactcttgagcttttaagtctactatgtctgaactgtggtttcttgtttatccttttttccttagttggactgtaatgtatggtctgtcaacctgtgaatctttaaagtatgattcaggtattgttgtattctttactgtgtaataaaaaagttgaaaaaaaaaaaaaaaaaacccaagggggggcccggtncctttccccctnt

SEQ ID NO: 42 - DNA, 1201 bp, Homo sapiens
ccttcactgagtttttcttatctccttttgcagtggttaactattgtcacaataatgctgaatgaaaaaacacaccaaatgtcagtggcttaaaatgaccatcctttttctcacagttatgaagattggctatggcacctctgcttcctgctataggcctgaggttctagggcttcttatgcctcatcctctttaagccaaagggatagccagagcatcttgatggcagaagtgcaataagatgagccccactgctcgggtacattttcagcccctggttgtgtcatgtctactgatatctcattggtcaaaggaagtcagagggccaagatgaagaggcagggaaatatgcactgcccacagtgaagccatgacaagagtgaggatgcaggaaggcatgaagaattggggccaacagttcaatctaccataccttctctcacctggaattccagatgcttgagctacgaaacttagatgcaaagaaagttaaagctagaaggaacctcaggcccagttgctcattttgcagattccaaatgtgaatttcagagagctgagataacttgcccaaggccatatagaggctgtgactaaatctggacttaaatccagactatcaatcttaggccagtgttcttttttcaatatagtccttggcataatgctatgcttattaggtagataaaagggcttatgtcaagaaatttggagcagagtctgattacttgagcatgaacatacccgaccaaggtatgttctggagtcatattctagcctctgagctcattttttcatgcgagttcatataaaatcctcgaaagtttagaaactaggttttagtagtaacggagctagaatcatcttcgggcttattcctgctagttgttccatatttctagatttcatcttgaattttgaaaactgatttaagaatatatttagtattattattagtaagggaatacgcaatccagtttcaattttattcagaagtaggtcacctaattctagaaaatggttattagtctagtgtcgcttagcaaggtacttaaaagaaaatctgcacatatccttgtgctgcccttcttaaaaacagaaaacaaaaagtgtaagatcatcattgcttcccacataggaaaaataaaatgtcttcagacttgatgtgaaaaaaaaaaaaaaaaaactcgagggggggccc

SEQ ID NO: 43 - DNA, 1176 bp, Homo sapiens
tttgattgttttgtaatgctcaagtttctgtcattttcaaatatgttgggcttgttcttcatggcaaacctagaatcctagactgccgctccccagaggaggttctttaagactgctcagctctcctgccaatagcaacaatgcaaaagcttaccccttctcccgtttccccagccccatcttcatgtcctgtggatgttgcttcatccacatttataatttactcctgtctctctgctatggtttgggtgttgaaagagtgaagttctttacctttagtattttaaaaaaagaaacaatgttgctcaattatttattctaaatatgttgttgggctttgctttatttaccctgtttgcatgtcttgttgatgtcttttcagtccttatggcccatcgacttccttatccatgacccagagaggccccagtgatattttgacttttcaaatgtggtgaataagtgagagttgtttgttgagttaactgtgattttaaatattctgattgttgtgaggcacttttctaggtgtttgatttcttgatctgttttcttctatgccaattgattaaacagtgtcttccacagtttgctaaggtgatgatggtgcctggttgttggttttggttggttgaataaagccctgatgctgggagttcattgttgtaggtggttcaagtggtggagtcctgtaagcattcctgtgtattcttctctgaataataatgctgcatattaagcctagcatcctacccatattaccacataaactgttaggtctgtcctggcttcaattcatgttggcgttcaccttaaattttaaaaataaagtttatgtttatttgaggggcaagtgactatgttgtaagaatgatatttttctgaccagtagttttattttatttttactttttatttgttccaagatggagtcttgctctgtcacccaggctggagtgtagtgacacaatctcggctgactgcaacctccacctcccgggctcaagaaattctcctacctcagctactcgggaggctgaggcaggagaatcgcttgaacccgggaggcggaggttgcagtgagtcgaggtcgcaccattgcactccagcctgggcaacaagagcaagatccgtctcaaaaaaaaaaaaaaaaaaaaaaactcgagggggggcccg

SEQ ID NO: 44 - DNA, 569 bp, Homo sapiens
cccgggtcgacccacgcgtccggcaggcagcagggaaggaagcagaggcttcctaaggctgttttcttagccgtggagaagcccgcgctttctacatgctcccaagtgctgtcatgagcacgttcctgacaagtcaggtgttcagattgcagtccctggccaacgtcaggattcttacaggttgaatgttaagctcaccgatcttggcctcaggtcctgcctggcttgcctgctcattttcacacgtgcagtggtgggtctgtctcatagcacaggtgcagtttagtgcagccacagtgtccccaggcagggcggggactggagcagcccccagtgtgccagcagtgtgggcagcggaggctaggggcccatctgtccctagcaccctccagggcagtcccgttttgcagcgggatttggcaaacccccctccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccc

SEQ ID NO: 45 - DNA, 986 bp, Homo sapiens
gcactggcctcttcactggtggccgagaaccagggctttgtggcagcactgatggtgcaggaggcaccggccctggtacggctgagcctggggtcccatcgggtcaagggcccactcccagtgttgaagctccagccggagggctggagcccatctactctctggagctgcgcttccgtgtggaaggacagctgtatgcacccctggaggctgtccatgtgccctgcctgtgtcctggccgccctgcccgccctctgctcctgcctctgcagccccgatgcccggcccccgcacggctggatgtccatgccctttacaccacatccactggtctcacgtgccatgcccacttgccacccctgttcgtgaactttgccgacctctttctgcctttcccgcagcctccagagggggccgggctgggcttctttgaggagctctgggattcctgcctgccagagggtgctgagagtcgtgtgtggtgtccacttgggccacagggcctggagggcttggtgtcccgccacctggagccttttgtggtggtggcccagcctcctaccagctactgtgtagcaatccacctgcccccggactcaaagctgctgctgcggctggaggcggccctggcagatggagtgcctgtggcctgcggaccgatgactgggccgtgctgcccctggcgggggactacctccgtgggctggcggctgctgtctgagccccgggagaccaggtgggggcaggactgtggcccttgtgggggccaaggcacactcctgtagctctgtcgccaaaaccctgcattccgcagtgccctcgctggcttgttttcttttgggccccggttgggagcaggctcctgggggtgagggtctgtctgagtctgtttttgctgctctagcaagatccctgagacggggtaagttataataaacagaaatgtattggctcagaaaaaaaaaaaaaaaaaaaagggcggccgc

SEQ ID NO: 46 - DNA, 1540 bp, Homo sapiens
ggcacgagggaactagtatattcaccgtctatgaggccgcctcacaggaaggctgggtgttcctcatgtacagagcaattgacagctttccccgttggcgttcctacttctatttcatcactctcattttcttcctcgcctggcttgtgaagaacgtgtttattgctgttatcattgaaacatttgcagaaatcagagtacagtttcaacaaatgtggggatcgagaagcagcactacctcaacagccaccacccagatgtttcatgaagatgctgctggaggttggcagctggtagctgtgggatgtcaacaagccccagggacgcgccccagcctgcctccaggtgcagtacaatgacatttttaaaaatcgcccagcaaaggtctttgaattttatttcatccaagaaaatccacagctctttaagctctagatttgtccaaatttaaaatcctgaagttagagatggtatttcactccttcctctattcccaggacctagctttttttttttaacatacacaatagggatttgataagtttctgatggctgcaggcatgtaagagcatttcagtggtattgaatcaatgaagaattttgttgacatgtgaaatcttataaaaatattctttaccgaaggactgagttatgtggcagtgggcaaattcattgtttcatacctcccctagtaactgggaaaaatatgttaatacatagtctctctgtttttctgcatttggaagctttcagaggaacataatgtagaggtgtttctttagcaaagtgcactgatagcaaacataaggattgcaggtggggcctgagagtcctcatgagatagattctcacagtgattagaagatggagtctcacgtccctgcctgtgaactttctggaaaaaccatcttctccaagctgccattgacaacaatatggataacaataataacaataaggcccaataaactcctttatctcttcttcagggggccatactgacatcttctcttccttggtttcccctccttgccccctaaatatccagtaactcattcaaaataatgtcaccttaccaagagcagcacccctaactttccataatattttcactttcattttccctccaagcagcccactcgtaggaccgtagaattgattcttccacctggagaattttattttctttagcctttttggttttcagtgacaaatcctcttctcgcaaggggtggtttccatagttgtttatatcctgccctcataatttggagaagtgttcacatctgccgtgggatgagactgtatctcttttctttcttttgggtctttctccagatagggacttcttatgcaactcaaggatgggtacatgaaaaataaaattgtactctgagccattactggtgggctatgtttatatggccattttaccatagagttatttacttctttttgtttctatttgtattgaggtgtgattaacaaataaaattgtaaatacttaaggtaaaaaaaaaaaaaaaaaaaaaaaaaaaaa

SEQ ID NO: 47 - DNA, 792 bp, Homo sapiens
  misc_feature (759)..(760): n equals a,t,g, or c
  misc_feature (774)..(774): n equals a,t,g, or c
  misc_feature (779)..(779): n equals a,t,g, or c
actttccagctaaaaaccaacaagtgtctgaggacacagtttaaactccaagatgatagggtcctccctcacctgggctcccacctaccctcatgacctccttttgtgaaatgctgaagggctctgcagctggttgtctggtactgctggcctttgctttctatttagcatgttccttctcccacaaaacaaaatcacattctcactatgccctgttcattcttcaggactatcttctgggaaacttttactacatacccctctccccctaatctgagtgtctgctttgctcaggtagcatgtgttcactggataaatccttgattcctggcactgaggcagggtttctgttcccaggaagcagaggcatactattctgtgaaggattgactgagtttctcctaataccaagcagtatctgagggaacagatgtctagcttaaaatcctccctagcacttgtcatagcagtgctacgtattgcctgtgaaggaagtttaataactgctgaaaggttcgattagctttatttcatcaggatttgtttgactttacaaattgatttgggttattycaacttttaggtctagtcttaagtataactggtacatattccttcaagcagccattacacctctcataaatttattatacacctgcatttttataactattatgctttttaattgttggccaccatttttagtgcttctgaattgttatggttctcaagcagcagttgtcaccttggttttgaatnnatgctgtgacggangcttncaggggaattccc

SEQ ID NO: 48 - DNA, 1497 bp, Homo sapiens
gtgtaaaaccagtttcgggttagccatgtccgttgcacacatgcatgcatgtgtgttcttgtgcgcgtgtgttttctgtttagcagagaatgcgctagagagcgtgatcatcctgtgctattcatataataaagatgaagtgagagaacattagaggaaccaaggccatgtgatggtacacgtctgacgttttttcctttcggttacatgtccgtatctcctctttcccctttttcccctttgtcttcatttggttcccctccctatagggagtttaggacaagaagaggctaaagtttcactgatgagcctttctgagggttctccattaaatccaaggacagaaaatgtacagtcctcttattagcataacgaagccatcagcattgcatcaagcgggtcctcgtacccttttccttgtaatggtgtttggtgtagggtcctgaggaagagctgccagcccctacctgatggatcaaaatccccttggcaccaaagagtgactgatagtgttaaccatcacaggagacatgtatgtatgtgtgtggaactctgacgtgtattttaaactttgcaatagcccaaagttaatttgtttctttgccatttgttttcgaatgggtgtggcattgcttataaaatgttgaatgtaagttgcctaggacggcgcctggcatatggtggaaactgaataaaggctgctaggtagtgtagactagatggactagaaaacagyacagatgcagatgctttcagatgttctctctgccacagagagacctttctgtgtgctttgttcaaagttgacagtgtgagtaaactaccatcaacaaggsgttacttttgggtaattttttcaatgkttatcccagttccttcatccgcttttacatagcctcttgkactgcaagctacactcagttttgaagatggtgggttagcgttagagtggtgttctgtggccagtggaggaggaagcttgctcactttaatgcagaatgtctaagcatcctgcgctaaccattggcaggaaggttatttcagtgagacgctggttccttctcacccctgcacccttcctggaatcaccactggttgcagaagcctatatagrgtggctcatttggacgaagtattgttaaggtggttattagaagactcgcaacttagaaaaggaagtaaacatgttaatactagctttcataaatccccctctctaaaaaacacccctttctaaaaaattcacattactaaggcatcccctacacagaatgtttagtagggaggtattaaaattaatagcaattctgagtaagttccttctcatgtagttaatgcagcatgatgaaagaaataaaagtctccttatttttttactttctgtgttgcttcttaaatatactccttcaagtcaggttagcttaccttgggtgtttgtattttgttggcttatgtttgcatgtgtgaattaaaaaaaaaaaaaaaaaaaaactcgag

SEQ ID NO: 49 - DNA, 1340 bp, Homo sapiens
ggcacgagaaagaaaggcgagagaaaaatcaaggcaccaaatttagattggaggtctcagaggagcagtgttttccctccttcgtaacagttgaacaacttccagatgtagctagctgcaccccctgtaaagatgcaggctctttacaatgaagacacatcttctgatgttccttctctcctgtatggccagatgcacaggaatagtgcccaaaagacctcagcctgctttccctttaaggggaaggagaagaaaaaactcctttttatttttactttctttcagcattgaatttttgttgtgtgtatggtgacttctgtttttgggaaacggaagaagccagcagcatgctgaattgtcctgacaggcttccgctggctcttgccgaggttagcagtgctttttttgtatttaaaccatctcccgggcagtgtaaaaagtttgcaggtgcggacattctgtctgactggtctcggcagtgctctataaccctgttgtgtttcttgataaaacacagccccaccctttaataaagcaaagattgctatgaaaccagagagtctattcattactgtggagtaactagagcagtctgtagtgactagacatacggcaattaggaagtcatggagttgggatttttgtcttaattttggctgctcaaagtgccccctgtaggatattcttttttcgggaattgtttccaaacttgcctgtctttatctatggtgaaactcaagccgctttttaaggcaagcctgcaaacccaagtatcaacatgggctcctgaaggcacagggagcagattcacagttctgaccagtgttagggtccccacgagggccacccatttgaactcaaggttggcagactctggccccagcacttgccgtggtttcaggatggccagcggtgacacagggctatggaaccctgggtcttcatctcttcccatatcctttgtttcaccttctttttgcccatattttattgtgcttcagatagaaattttatttataagataaaaagtagctctgaggctgggcacggtggctcatgcctgtggtcccagcactttgggaggccgaggtgggtggttcacgagctcagcagatcaagaccatcctggccaatatggtgaaaccctgtctctgctaaaaatacaaaaattggctgggcgtggtggcgggtgcctgtagtcccagctactcgggaggctgaggcgggagaatcgattggacccaggaggcggaggttgcagtgagcctagatggcaccactgcgctccagcctgggtgacagagggagactgcctcaaaaaaaaaaaaaaaaaaaaaaaa

SEQ ID NO: 50 - DNA, 1539 bp, Homo sapiens
cgatggccccgcggccgctctagaaagtcccgttttttttttttttttttttttttttttttttagagtacgttctgcattttatttytgcaggcaacactttgctcaccagcaagaacacagcccraggaagggacccaataacctttcaaaacscaaactgctkcctgcggtgagggcccagggtcctccacggagaggacaggcatcttcctttcccaccaggaaggagtcagcccggagcctctgctatgtgcaaggcggtgtgcaagcaccggctgcrgctytttgctgtctcttctttctctttggggctgggctgggtgtgcgttctggtgctgatgctttggcctgtgaggctgagcttggcacctcgacccgttcaattacagcaacgaagaagccactgctgagtgtggtctcaggggaggcccggaggcagtgctcggcacccgggaacgtgctcaggcctcggtggggccaggcaggcagggcgggagctagcctgaaggcgcccgggttctgctgcagcgcatctcgcaccacgtcttcattctcctcctggcagagggagcacgtggagtagacgagccgctgcagggaagggaaagtgagcgcgtggcacagggctcgctgctggaaccctgccagggcatgcagacgcaccgggctaggtgtgcctgccccgggctcctccagctgtctgctcggcatacccgagccactgcaggaaggatccagcaggayrtagtggacctcaygrtagcgyggatcyragggggagaccgccaggaagtcctcctcagccagytcacagcargagacgccagcccrggccagcagcgtggccatggatgccagccgcttggcatccaggtcaaaggcaaagatcttcccttggttcttcagaagagcagccaagtgactggtcttattgcctggggcggcacaggcatcgatgacatgggagcctggcggggggtccagcagcatggctgggagacagctggccctgtcctgcagaatgaggtgtccggcccggtacagtgggtgttcatgcagatctgtctgggcgggaaacaccagcagctccggcatcaaggggtccaggagaaaatgcttccccttgagggctcgtaagtcatcgaggctggaagcccgaccctgataggagaaaccttgtctcttgaaataatcaactacatcatcggagcaggtcttgagagtgttcacacgcacaaatcgaggcagctgggaggctggaccaggcctggatcccacttccaacaggtcctcattccggctcacaccccgatgaaccttgagccgagccaactcagccttgagcctcgcctggtgccggcccaacagagccttccatcggcccccaccccctcgaaagccctttcccaacaacaactcatacactagcaccttggccaggtgcggccgctctagaggatccctcgaggggcccaagcttacgcgtgcatgcgacgtcatagctctctccctagagtgagtcgaatgaggttcata

SEQ ID NO: 51 - DNA, 1423 bp, Homo sapiens
ggcacgagcttgaacatatataatgaagaaatacagtggctctttattaaaaataatagttggataatataaactgaactatttatgcatttttatatacttataaatccttccaaatagttttaattctatccttttacatataaataacttaataagtgtgctggaaaaacacagatgttcacagcaccactgttttttttttttttttttgagataataaattccatgagaaatctgggtttgaatatttgtttactttgtctcctaattgaacaccactccaggccttctgtctgtctcccctttacccccaaaatactcacaaaaaaattttaagacaacaagtaaccatatataggtgtttgaatgattttctcatttttatctaatttcatttcataagtcccgagtaatttacctaccataggctactatactgataatataaatgaaaccgaacattttttgctactaactctccccaatttaatgtgttttcgaaataaaaatttaaatttttttccttttaattaaaaagtcatctttgaagtccttattggctgtacattttacatgtttgctggtactattattttgtcagtcagttaaagctggcatgtacagctcttggctttaatgaaaagcacattgacataatgttagtaaattccaaaccccggcacagaatgtgagttaaaattaagtcttgctgggttagtgtacaataaactatacctacagacttttttttaatagaaagaagacaaagctgctggtataggatttgtcctttgaagaaaaaatgagggaaacaaacacaaaaacccaatgcagtgtataaataacattttgttcaactacctcttaatgtggaattatctactttaatagtttcctgacagtaatgttaaatagtaactgccaaatttgttattttcccatctctcttaaaaaagtctttatgattattttatatagttttgagaactttaaagccacttttttttaaccttacatttgcataaaaatgtttagcttttaagtagagagcaaattatgatcatatattttgatattcatgacctgtttgactataggagttttttttaaaaaaatgcactttggctataaaaccatggatgatttgatccataagatttaaatgtgccaccattatagtattcctagacatgagcttgatgaatggtattctgtaattataacgtgccccacattattgtgtcttaattgcccttagcctgaattttaatgatcaatttgttattgttgcagatgtgaatattgtgcataaacttactaaatttatgtaaaattgtataaaatagaattagaagtcactaagttctttctgtgtagaagtaataaatttattgtaacacaaaaaaaaaaaaaaaaaaaa

SEQ ID NO: 52 - DNA, 1364 bp, Homo sapiens
tctacagtaaaccccaccattaccttctagttggcataaaaacaagaaccacaaaaacttgaaaaatctgaaacagagaacagaaggccaagagccagcttctgcgttctcaactttattcaacattagacttaccttatttctttcagtgtgtagggacaagatgtactgctgtgtgtgtgtgtgtgtgtgtgtgtgtgtgtgtgtgtmtataccttcctatccattggcaagttaacctccatctggtttatttggccatgctatgctttcttcccattcccctgctgtctattctaagcccccagactcaagcctctagactcttggatgaaacagtgagaagaaaacattttctgacttacccttttggaatctcctccattattacccaggctttgctttaagttgcactttaaatcacactgtcctattaatgcgatctggcatcttctcccacaagccccctacagggaacaactaccccctaccttaactctaaatggttctttagactatagtctgtctcctctgacctgaaatcctcttttaggcaataggccgagctttagaagcagccaggtctggtgagaaatgggcccccataccaactgtggacttggaatatcagcagagtagtaggcacagttgtaaaaaggggagatttcggtaggcacaggtgtaaaaaggggagatttcagaagacgggcgaaacaactgatgggggaagatacctggggtgagaagatgagaaagaaatgatgctgagggacctagtgaaatcaatgaaactcttgagtcttgcttaggctcgcaaacaagaagtggggaggcttgggaaattaggatatgacatatatgaaaggtttatctaagaagaaagaaacagagataatatatatatagaaagatgtatatagatgtatatatgcccaaatatattgaatgtacagaaaggaaatattcagagactttagcattgggggcagatatcttggcctggttatggggtaggacacccagattttcagacttacaatcagtggtcctggtttcaacatggaagtgagatagctgatgaaggatttcaagtctggaaatgggaaagggaggggtagaagttccttttcagaaataaagaggcattcatgaaggcttttgttgaatcctatgctactgataggaccaggaagagaggaactcggaggacaatagggaggggaagtcttggaaaatctaccacttacactgtgtgtccccatccccagcagcgtcctgccactgtagcgcctttttaaaataaataaaataaaataaagcaccaaaaaaaaaaattaaaaaaaactggagggggggcccggtac

SEQ ID NO: 53 - DNA, 2288 bp, Homo sapiens
  misc_feature (940)..(940): n equals a,t,g, or c
  misc_feature (1279)..(1279): n equals a,t,g, or c
  misc_feature (1798)..(1798): n equals a,t,g, or c
  misc_feature (2280)..(2280): n equals a,t,g, or c
  misc_feature (2285)..(2285): n equals a,t,g, or c
gatcccattcttctctcggtgggaatgcttgtggggggaaaaagaaacgcaatagataaagcggggcgcatgcgctcccggcacaggcwtcgattgtgaggaargccggctagtctccgagctcatcccgccttgcgcatgcggagaaggtaaaccagcgccccgagttgaggcgcgggtttggtggcgcgtttcagcgaagtcgcacgtgaaggatagcagtggcctgagaaagacccagtcatggcagcctccagcatcagttcaccatggggaaagcatgtgttcaaagccattctgatggtcctagtggcccttatcctcctccactcagcattggcccagtcccgtcgagactttgcaccaccaggccaacagaagagagaagccccagttgatgtcttgacccagataggtcgatctgtgcgagggacactggatgcctggattgggccagagaccatgcacctggtgtcagagtcttcgtcccaagtgttgtgggccatctcatcagccatttctgtggccttctttgctctgtctgggatcgccgcacagctgctgaatgccttgggactagctggtgattacctcgcccagggcctgaagctcagccctggccaggtccagaccttcctgctgtggggagcaggggccctggtcgtctactggctgctgtctctgctcctcggcttggtcttggccttgctggggcggatcctgtggggcctgaagcttgtcatcttcctggccggcttcgtggccctgatgaggtcggtgcctgacccttccacccgggccctgctactcctggccttgctgatcctctacgccctgctgagccggytcactggctcccgagcctctggggcccaactcgaggccaaggtgcgagggctggaacgccaggtggaggagctgcgctggcgccagaggcagncggccaagggggcccgcagtgtggaggaggagtgagccggatgccccacacaccgccagtgtcataccaaagagctgagctgcttcggggccatgcagccctcctgccagccccctgcccttttcttgccctgtctctgaaccttcagaacattgatccttgccgcagccccactagccaagagaaacagagaaagaccattccccctgcctgtccttgcggccctgtcttctgaggttctctgtctggggttggctctcttaaccctttctctgctcccagcctgcctcaccagggaaggttggaggggcctccctctggcttctgcatctgcgccanaaacatcactgccgttggtctctcatgacttaactggcttccctctgctgctgccttggcttcctcctaatgctcgtgctctcctgtccttctgaagttgctccttggccaaatctccagctcccttcttgttttcctcatcctcctaccctgtactcccaccaaaccatggtcctttaaggcacgctcctgtcctcctcattgcccagcagtagggaggggcaggggtaaggggacctgaggataaagggtggggaaacagggtcccctgaggcctgtgggggctgcaggggaggaggatgtaccttgtgtctctttcaagtgccttaatccgagccagcagggccttctgcttgcctgctgccatactgtatgtaggaaagtgttctgtggctgctttgtgtcaagaaaagagcagtcactctcagaatcttgattccccatcagccaaagcaaaagatggctgctgctttgtaggcatgtgcctgcaagtgggaccttgctgggcattatatgccntgtgggggtttcagagaccctgaaagaggagggaggacccgcctccttgtctgcacaactgcatgcacttctctccccatcgctccacaacctgaaaccgagaaggagttgctgaccagtgcccaccccggcagcccgggaggaacacaggcagctcctttcccttcacgtggtctgcagagagcagggtgagctgccagctgcccctctccaccagggtaccctgtcttggtggttaggggccacttttcctttgaggctctagtggaggtggatgtccttctctgccaggcttggcacatgatgtgaagaataaatgcccaattcttactgttcaggtttgatgtggaatcacagctgcagtgatatatattttttatcagtgcttggttggttttaaataaagtgcacgctattttattatcttgttctgaataaaatgtatttactccaaaaaaaaaaaaaaaagggsggccctctanagggncca

SEQ ID NO: 54 - DNA, 1512 bp, Homo sapiens
  misc_feature (2)..(2): n equals a,t,g, or c
  misc_feature (8)..(8): n equals a,t,g, or c
  misc_feature (16)..(16): n equals a,t,g, or c
  misc_feature (21)..(21): n equals a,t,g, or c
  misc_feature (29)..(29): n equals a,t,g, or c
  misc_feature (528)..(528): n equals a,t,g, or c
  misc_feature (600)..(600): n equals a,t,g, or c
  misc_feature (1496)..(1496): n equals a,t,g, or c
cngaaaanccccgtgncattntgggaaanaacgccccgcaggtaccggtccggaattcccgggtcgacccacgcgtccgcccacgcgtccgctcgctggtctttgtcctcttctgtgatgaagtgagacagtggtacgtaaatggggtgaattattttactgacctgtggaatgtgatggacacgctggggcttttttacttcatagcaggaattgtatttcggctccactcttctaataaaagctctttgtattctggacgagtcattttctgtctggactacattattttcactctaagattgatccacatttttactgtaagcagaaacttaggacccaagattataatgctgcagaggatgctgatcgatgtgtyctycttcctgttcctctttgcggtgtggatggtggcctttggcgtkgccargcaagggatccttaggcagaatgagcagcgctggaggtggatattccgttcggtcatctacgagccctamctggccatgttcggccaggtgcccagtnacgtggatggtaccacgtatgactttgcccactgcaccttcactgggaatgagtccaagccactgtgtgtgnagctggatgagcacaacctgccccggttccccgagtggatcaccatccccctggtgtgcatctacatgttatccaccaacatcctgctggtcaacctgctggtcgccatgtttggctacacggtgggcaccgtccaggagaacaatgaccaggtctggaagttccagaggtacttcctggtgcaggagtactgcagccgcctcaatatccccttccccttcatcgtcttcgcttacttctacatggtggtgaagaagtgcttcaagtgttgctgcaaggagraaaacmtggagtcttctgtctgctgttcaaaaatgragacaatgagactctggcatgggagggtgtcatgaaggaaactaccttgtcaagatcaacacaaagccaacgacacctcagaggaaatgaggcatcgatttagacaactggatacaaagcttaatgatctcaagggtcttctgaaagagattgctaataaaatcaaataaaactgtatgaactctaatggagaaaaatctaattatagcaagatcatattaaggaatgctgatgaacaattttsctatcgactactaaatgagagattttcagacccctgggtacatggtggatgattttaaatcaccctagtgtgctgagaccttgagaataaagtgtgtgattggtttcatacttgaagacggatataaaggaagaatatttcctttatgtgtttctccagaatggtgcctgtttctctctgtgtctcaatgcctgggactggaggttgatagtttaagtgtgttcttaccgcctcctttttcctttaatcttatttttgatgaacacatatataggagaacatctatcctatgaataagaacctggtcatgctttaaaaaaaaaaaaaaaaaaanaaaaaagggcggccgc

SEQ ID NO: 55 - DNA, 1357 bp, Homo sapiens
ggcacgagtttatttacaggcatataaaatgaaattgtgagatgttttgcaagcttctttttactttgagtagcttttaatttgtatgtttttatgtggatgaagagcattttttatgcttttgtgcaataggttccaatatgcatttattagacatctgtttaaatggtaatgtagcatttattttgctaaattgaaagggaacatagatggaattccaaaatatgtacattcagctgtttggtttttcgtttttcattgttattattgtgagaatgctgttattggggttgtgtgtgagtgcccgtcagccagtgatgcctcgggccacgctgtggggccacctcagtcctgcctgggtcctggtgccttggaccccacgtgcttgtggccaggctgcccctgggcggggccatgtggcctcagaccacaagagcggactgccctggcccaagcactgcagctgcctgcacccccgggcttcgcagccttgcttgttttctctgaacagcaacagaacagtgttcacagcgattcaaagggtggcattgggttggacgttctgggtacaagccaacctagtcccacgttgtacgtgaatgtttaatgtgctctcaaaacatggaaaataagtttagtgcacatagctaaatcacaaaacatccaatttctctgtttcctcaggaagtcattactgcgccaccacatcacatgaccttaacatgatcaatgtatttctctgccttgacatttaaatacataaattgagataagtagattagaaaatcattcaaatgataccataatttgtacgggacagggtgcgggcaatggccacgtggccaaggccccgcaggaacgcgccgaggtctccctcaccctccaggtgtccttcgcacccaacagtgcgtctgaggaacgagctgcagtttgagcgttcccctgagatgtgcgtagcctccgtgtaaatgtccactcccatggcttaattgcctatcagacgcattttcccagacgaaagcaatgttgggttggggaagacagtgcagccacccagcctttaccagcagcgtacggcagacgaaggcagtcgaggtgtggaggtgatcacgaagatacatgtgtttgactgtttaatttgaaagtttacattttttatgctttgtgttggtgtgtaatttttgtactcttggtggctagtttttgtcaaatcttttttggaatattgcttaaatgttttgattttatgatagtgaagcttgtattcagtgttttgccaattaatattatatgcttgtaataaaagcaaaagaaaagcttaaaaaaaaaaaaaaaaaaaaaaaaaaaaaaaaaaaaa

SEQ ID NO: 56 - DNA, 1989 bp, Homo sapiens
  misc_feature (31)..(31): n equals a,t,g, or c
  misc_feature (161)..(162): n equals a,t,g, or c
  misc_feature (1702)..(1702): n equals a,t,g, or c
  misc_feature (1943)..(1943): n equals a,t,g, or c
ttaaatgaaatcaaaattggccatttgacanaagttggtttttcccctttctgcatttttaggacctcaaagtaatgtttatccagaaactgctatcattaccagggattcattcgtgtatttaacaacatggggcatacattttggccaaatttgaaaanntcttaacatacaccccaaaatccctgccccaaatttaagaactagggtggacacagtgcgtttttccatgtcgcatcttctgtgatggggctacgatacgtgggagcagagaatggggaggttggagcgcatgccagatgaggatctatcagcaatgggacgggkcctccactttagcatctcyaccctgctcctytcagaggaccgcctttcattgcattcagctgtgatggtagcacgaacacaggtgcaccgaggacgaggagagcaggagccttgtgctctctctgcatctgaggcaggacagcacagggtayggagcagtctgcagagaggccagctcatcagggaagcacttgtcttccaccttgggctttgactgagcactgggcaattggmcyctggggatcaaygaaataatcctaarcagagttactctatgtcacactatggaatgttccaagtasrtggccgtgttttcaaaagatrtattttctccttttgttgttgccatttcataggtttaggattgggtgtgtgtktctcctctctgaatggcactcraatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactamacaagcactgagctgattgttgagccagaggagccctcagacagcagtggcatcaacttgtcaggctttgggagtgagcagctagacaccaatgacgagagtgatkttatcagtacactaagttacatcttgccwtatttctcagcrgtaaacctagatgtgraatcamtgttactaccgttcattaaactgccaaccmcaggaaacagcctggcaaagattcaaactgtaggccaaaaccrgcararagtgaakagagtcctcatgggcccaaggagcatccagaaaaggcacttcaaagaggtrggaaggcagagcatcaggagggaacagggtgcccaggcatctgtggagaacgctgccgaagaaaaaaggctcgggagtccagccccaagggagstggaacagccycacacacagcaggggcctgagaagttagcgggaaacgccrtctacaccaagccttcsttcacccaagagcataaggcagcagtctctgtgctgamacccttctccaagggcgcgccttctacctccagccctgcaaaagccctaccacaggtgagagacagatggaaagacwwmacmcacrctatttccattttagaaagtgcaaaggctagagttacaaatatgaaggcttctaaaccaatttcacattccagaaaaaaataccgctttcacaaaactcgctcccgcatgacccacagaacacccaaggtcaaaaagagtccaaagttcagaaagaaaagttatctgagtagactgatgctcgcaaacaggcctccgttctctgcagcgnagagcctcataaattccccttcacaaggggctttttcatccttaggagacctgagtcctcaagaaaacccttttytggragtatctgctccttcagaacattttatagaaaccactaatataaaagacacaactgcaagaaatgccttggaagaaaatgtttttatggaaaacactaacatgccagaagtcaccatctctgaaaacacaaactacaatcatcctcctgaggcagattccgntgggactgcattcaacttagggccaactgttaaacaaactgagaca

SEQ ID NO: 57 - DNA, 2543 bp, Homo sapiens
  misc_feature (2538)..(2538): n equals a,t,g, or c
ctccgttggaaacttgggctgagtaccgcggcgggcgcgagcraggcgccctagacatcttctccctcccttgcctcagatttattgctaaacatgggtgcatttttggataaacccaaaactgaaaaacataatgctcatggtgctgggaatggtttacgttatggcctgagcagcatgcaaggatggagagtggaaatggaagatgcacacacagctgttgtaggtattcctcacggcttggaagactggtcattttttgcagtttatgatggtcatgctggatcccgagtggcaaattactgctcaacacatttattagaacacatcactactaacgaagactttagggcagctggaaaatcaggatctgctcttgagctttcagtggaaaatgttaagaatggtatcagaactggatttttgaaaattgatgaatacatgcgtaacttttcagacctcagaaacgggatggacaggagtggttcaactgcagtgggagttatgatttcacctaagcatatctactttatcaactgtggtgattcacgtgctgttctgtataggaatggacaagtctgcttttctacccaggatcacaaaccttgcaatccaagggaaaaggagcgaatccaaaatgcaggaggcagcgtgatgatacaacgtgttaatggttcattagcagtatctcgtgctctgggggactatgattacaagtgtgttgatggcaagggcccaacagaacaacttgtttctccagagcctgaggtttatgraattttaagagcagaagaggatgaatttatcatcttggcttgtgatgggatctgggatgttatgagtaatgaggagctctgtgaatatgttaaatctaggcttgaggtatctgatgacctggaaaatgtgtgcaattgggtagtggacacttgtttacacaagggaagtcgagataacatgagtattgtactagtttgcttttcaaatgctcccaaggtctcagatgaagcggtgaaaaaagattcagagttggataagcacttggaatcacgggttgaagagattatggagaagtctggcgaggaaggaatgcctgatcttgcccatgtcatgcgcatcttgtctgcagaaaatatcccaaatttgcctcctgggggaggtcttgctggcaascgtaatgttattgaagctgtttatagtagactgaatccacatagagaaagtgatgggggtgctggagatctagaagacccatggtagccttaaaaaccttctaaaatgcttttrattctgaaaattgggggaaaaaacttttaatcacaattttcttcaatacaaggggaaaatattcttgcggattcccaacgttttgtgatatgagcagaaaatcattagcatttcccatcatttgttcatatttgtgttttctgacagttgccacttgtagcattgcctgtactacagtattttttgccaacctcaggcatactcgttacatctgtattgaactttcggccctagaaaccagtggagttatttcaccacaaatcaacaatgtgcctgaggtgcatgggaaatatagttagctatactctgaaaatacattatgttttttttctttaaacaaaacacacaacatgtaagcatgtaagagtaaagaattgtatgatatgttccttttttcagttcaccaagttggaagccttttgcagctctgtggcttggaatttcatttgagcaatttctataggatatgtatttattattgattgttatttaawwwwwttccamttttacctgtattaccaaactgggttctccaataatgtccaaattgtaatgttgccttgcttcaagataaagtgtatttgggaataatattataaacccttmcaaattttatgcatgtatctactgcatccttcaactctcactagaaaatcttttgaaaccaaatggattaatttatggctatttataatttgctttgacatctcactgttggaaattttttaaagatgagatttgcctttataatgtaaattgtgatttttgttttacatgtgggtttctatagttttaattttttcagcttttaagatacgagttttgtgtaatttggtatttttaatcatttatgttattttaaaagctcagaatatcacattgaaattactataaatacatttaaaattatctattttagatctaaggaaatactacagagatattttcatgggttcagtaacttttcattttataacattgggcacggtacagagtgattgtcacataaggtacttgaagatttattagtttaattctatttttacagtaaccttgaattcttctgagttttgcatgtattaaattcaattaatgctgaacatgaagagtaaagtatttatctgaaagaagtttctgggttaggagaagtaatgaatgtatccatttgtacatggtttacatgttgtggatgctttgtaaacattttcctgtatgtttaaattgtgtttcagcaggatgtagttgcccttgtgnaggtt

SEQ ID NO: 58 - DNA, 777 bp, Homo sapiens
  misc_feature (766)..(766): n equals a,t,g, or c
ggcagagcgttaagtcctcattccctccttctcctcttcctttctctgcagtaggggaggcccactcccgksggatctatcttgggatcccatggctttctttactgggctctggggccccttcacctgtgtaagcagagtgctgagccatcactgtttcagcaccactgggagtctgagtgcgattcagaagatgacgcgggtacgagtggtggacaacagtgccctggggaacagcccataccatcgggctcctcgctgcatccatgtctataagaagaatggagtgggcaaggtgggcgaccagatactactggccatcaagggacagaagaaaaaggcgctcattgtggggcactgcatgcctggcccccgaatgacccccagattygactccaacaacgtggtcctcattgaggacaacgggaaccctgtggggacacgaattaagacacccatccccaccagcctgcgcaagcgggaaggcgagtattccaaggtgctggccattgctcagaactttgtgtgagttgagcccaggcctctggttgcaggactcgtgaatggagcagttctgagaaccacccttttgctaagggagcttgggagccacatggctgctcccttcacactgggtaacagtgtagtatcctgtgagagaataaatgtattcatttatgtgtttttccagagctttctgggatgtgggaaaataaattacactgaagcagttgaaaggtgaaaaaaaaaaaaaaaaaaaaaaaanaaaaactcgag

SEQ ID NO: 59 - DNA, 879 bp, Homo sapiens
gctgcatgctgggcgggaactaggaagcctccccaacctctggccccgtggagccctcagcctcagctgcagtggaggcacctcgggctctggggcaaccaagtgtgacaggtggctgtgcacgggcagaggtcctgtggaagatttcatgtgacgggcagaagaggaggaggaggcaggggaggaagcacatccatgaacagggctgtctgggggcagcctgggtggtcgtgaaataggactcagtggccttgagtcctcatttaggccctgatgttctttagcctgcctggcctttggcaaatcgccagcttcacgcacaacctcatttttcacctttgggtgtgggggtcagagtcgggagagcacctgcaaagccacaatgatccagacacacggcaaggtgggcacattcccatcaggctcctcggggagagcagcgcttctgtgcccgggagcagcgaaggtcacacaggaggacccgcacctcctcgtgtcggtggctccgctggtataatcaggactcacgtggtgttcctcgtgtcgtggcccttattgcagagggagcagcacaggctttcctggaagctcccctcggtcatgtggggtgactccagagarccccaccttgcgagactggaccagtccaagtggcctkgagccacarcggcctkgcagtacctkgggagggggtgatgacaggtgcacacggaggcccatgtggtctgtctggagaatgccggagatgtgaaatatgtaatcctgagtgtggcttctagaaggaaggttcgcaaagctgaatatccactcgtgctgttcccttctcacaggagattcctgtcaacgtccgattctgcctcgaaggcaggaggagtaagg

SEQ ID NO: 60 - DNA, 1161 bp, Homo sapiens
ggcacgagtcgtccagcccgcggcgagagcgggtatgtgggcgggaggccggagcagctgtcaggctgaagtcctgcgagcgacgcgcggcggggcggcgagaggaaacgcggcgccgggccgggccctggagatggtccccggcgccgcgggctggtgttgtctcgtgctctggctccccgcgtgcgtcgcggcccacggcttccgtatccatgattatttgtactttcaagtgctgagtcctggggacattcgatacatcttcacagccacacctgccaaggactttggtggtatctttcacacaaggtatgagcagattcaccttgtccccgctgaacctccagaggcctgcggggaactcagcaacggtttcttcatccaggaccagattgctctggtggagagggggggctgctccttcctctccaagactcgggtggtccaggagcacggcgggcgggcggtgatcatctctgacaacgcattgacaatgacagcttctacgtggagatgatccaggacagtacccagcgcacagctgacatccccgccctcttcctgctcggccgagacggctacatgatccgccgctctctggaacagcatgggctgccatgggccatcatttccatcccagtcaatgtcaccagcatccccacctttgagctgctgcaaccgccctggaccttctggtagaagagtttgtcccacattccagccataagtgactctgagctgggaaggggaaacccaggaattttgctacttggaatttggagatagcatctggggacaagtggagccaggtagaggaaaagggtttgggcgttgctaggctgaaagggaagccacaccactggccttcccttccccagggcccccaagggtgtctcatgctacaagaagaggcaagagacaggccccagggcttctggctagaacccgaaacaaaaggagctgaaggcaggtggcctgagagccatctgtgacctgtcacactcacctggctccagcctcccctacccagggtctctgcacagtgaccttcacagcagttgttggagtggtttaaagagctggtgtttggggactcaataaaccctcactgactttttagcaataaagcttctcatcagggttaaaaaaaaaaaaaaaaaa

SEQ ID NO: 61 - DNA, 687 bp, Homo sapiens
ccgggtcgacccacgcgtccgactagttctagatcgcgacggccgccctttttttttttttttactgccaggtagcaggctttattgggaagggacaaagcctcaggagctgggtgccccagaggctgctgggtcttgagccacagctgcagccaatgcagcagtcgcgcctccttcttccgtttctgtttttcctccttgagggttgcgctccttcttctctaggtcctggagcagctcctggaagcgggcactccttgggtccacctggtagcccaggagctcctgggcctcagcctgcagtcgggccctcctctccttgtcagcctgggccttctcccagttctcccgctgctgctgctgccagttcacaatcatctgtggcatcttggccatgcactctgcgatgtgctgctccctctcccgacgcttctgctcttcggccagctgcttcacccgcagcgactcctgcatggtcgccaggctcgggtaccattcgcgttcttcggcctccagctcccgcagctgctccggcgacggccataacgaaccggggaccaccccggaggcggcgccgtaacgcgcgaactgcttagcgcgtagcgcggtcccagctgccaccgcggggtcaggaggtcctcggggtctggccaccggggtcccggtgcggcgcgggggcggccgctc

SEQ ID NO: 62 - DNA, 518 bp, Homo sapiens
acgcgtccgagatacattccatgaatacctagtttattgagagtttttagcatgaaggactgtcgaattttgtcaaaggctttttctgcatctattgagataatcatgtggtttttgtctttggttctgtttatgtgatggactatgtttattgatttgcatatgttgaaccagccttgcatctcagggatgaagccaactcgatcgttgtggataagctttttgatgtgctgctggatttggtttgccaatattttattgaggatttttgcatcagtgttcttcagggatattggtctaaaattctcttttttttgttgtgtctctgccaggctttggtatcaggatgatgctggcctcataaatgagttagggaggattccctctttctattgatcagaatagtttcagaaggaatggtaccagctcttctttgtacctctggtagaatttgggtgtgaatctatcttgtcctggaatatttttggggttggaactcaaaaaaaaaaaaaaaaaaa

SEQ ID NO: 63 - DNA, 911 bp, Homo sapiens
  misc_feature (911)..(911): n equals a,t,g, or c
gtctgaccaggggtactaaataaaccggccctaacacttccatctccacccaccccatctccctggcgatgtgctccagcccaagcagcctccgtaggctttagatcctgtggttgccagatccagtcctttctaataccctgagtcaacacattactcctgcaggtcttaggctacaatgcaggtcccttgagggccaccaacatggaggtaggcagtttctaggactgtccccagtacatctcaccacccacagccctttttttgccttgattcgagcctcaccctggccttttggcttcccctgcctgagagagacctgaggaggggacagagcccagcccctctcctgtggctgagcaggcctctgtgtccatgacacctgtcttccgggcctgggggctgtgggtgtatgtcctccctactggcttccccggcccctgctgcatgatgctcttggaactcttccccaaggagtcagtcccccaggcctatcaggggatccttttgtatctgcactttgggttttagtttcaaagctccatcaggtacagcttgcatttcaggatgtgtggaaagctcgggtgagggctgccctggttcatcatagctccaccttcctcggaaggagtgggctgttggagaccccccatccatggcacactagctcagcactgcatttcccgagatgattcccaagacagctggtgcctcctggctttcctgtgccaggccaaggggcaccacagaggaccctggatcctttgcctcttcttggttgaaggatctctatgtatgtgtgtatataaatatagttttttatctatatatataaaaaaaaaaaaaaaaaaaaaaaaactcgagggggggcccggtacccaattcgccatatggtgatggcaaatgggaan

SEQ ID NO: 64 - DNA, 963 bp, Homo sapiens
  misc_feature (2)..(2): n equals a,t,g, or c
tncagaggccctgcggagttgttcagaaccccaactctctctggctggctaccccctgaactactgggtctctggacccattgtgcccagccacccccaaaagccctcaggcgagagctgcctgaggaggcaccgctgaggaggaaaggagaaagattgaagttccaagtgagattgagagatctccctagaggcagctgaagaggagaagtcccgcatcagcctcatcccaccagaagaacggtggtaagcggccaggctccgtggragccagggcccamagcccttggccagktkgtggaaacagctgctgggatgggtatgccccttgtcactgtcacagctgccaccttccctactctctcatgtcctcctagggcctggcctgaggtggaggcgccagaagctcctgcattgcccgtggtgcctgaactccctgaggtgcccatggagatgcctttggtgctgcccccagagctcgagctgctctcactggaagcagtgcacaggtaccaggraggtggcaccttgatggggtggacccgggctgaagcctctgctaatggttcttgatccctatagggcagtggcactggagytgcaggctaacagggagcccgacttcagcagcctggtgtcamctctcagcccccgcaggatggctgcccgggtcttctamctgctcctgggtgartgtatgcatgtgtgtgtgtgtatgtkgggcagggacacagagaccagaggcccgtacagggactcccccgacctgccctctcctcgcctcttgaccagtgctctcagcgcaacagattcttcacgtgaaacaagaaaagccatatggtcgcctcctgatccagccggggcccagattccactgaggttagagtccatttacaaagctgccaggaaaccggccacttctagtaaaccacgtcgtgcctcactgaaaaaaaaaaaaaaagg

SEQ ID NO: 65 - DNA, 1001 bp, Homo sapiens
ccctactctcatctgctccagccccctgaccttatagttgcccagctttcctggcaattgactttgcccatcaatacacaggatttagcatccagggaagatgtcggagcctcagatgttaattttctaattgagaatgttggcgctgtccgaacctggagacagagtatcagcgcctttgcttgctgctgtttttgctgttttttgatgctgggaaccaccacctaaagatagtaaagaaaacacaggaagctttccggaaaacaaaaagtcctttctcctgattcaccaaaaaataaaatactgactaccatcactgtgatgagattcctatagtctcaggractgaagtctttaaacaaccagggaccctctgcccctagaataagracatactagaagtcccttctgctaggacaacgaggatcatgggagaccacctggaccttctcctaggagtggtgctcatggccggtcctgtgtttggaattccttcctgctcctttgatggccgaatagccttttatcgtttctgcaacctcacccaggtcccccaggtcctcaacaccactgagaggctcctgctgagcttcaactatatcaggacagtcactgcttcatccttcccctttctggaacagctgcagctgctggagctcgggagccagtatacccccttgactattgacaaggaggccttcagaaacctgcccaaccttagaatcttggacctgggaagtagtaagatatacttcttgcatccagatgcttttcagggactgttccatctgtttgaacttagactgtatttctgtggtctctctgatgctgtattgaaagatggttatttcagaaatttaaaggctttaactcgcttggatctatccaaaaatcagattcgtagcctttaccttcatccttcatttgggaagttgaattccttaaagtccatagatttttcctccaaccaaatattccttgtatgtgaacatgagctcgag

SEQ ID NO: 66 - DNA, 1558 bp, Homo sapiens
gcacatgcggccttgcagctctccttacgcacatgcgggccttgtagctctccttacccacatgcgggccttgccgctctccttacccacatgtgggccttgcagctctccttacccacatgcggccttgcagctctccttacccacatgcggccttgcagctctccttacccacatgcgggccttgccgctctccttacccacatggggccttgccgctctccttacccacatgggggtcttgcagctgtccttacgcacatgcgggccttgcagctctccttacccacatggggccttgcagctctccttacccacatgcggccttgcagctctccttacccacatgcgggccttgcatgctgttggctctggagcctctcgtctcacaggtctctacaggtgcaggccactcaccgtctggtggtcaggaccataaaggacagggttatgttaaaggttttgcctcaaaccagaaggcgaggaccctttctgtccagttgccggaatgatgtcatgaggaactgtgtgcccaggcacgctgtgctagttacaacatgtgtttttgtttcattccccacacactgtaaggtgggcatcactgggcccatcacacaggtgaaacagaagcccgggaatcactcgtccccttgcccagtcatacaactagtagccaaggcagaatttgaactcatgttgccctcagtcccaaaacctgtgtacttaacccttgttctctcctgctggtgtctgtgtgatgtcccatgtctgtctgtctctctctaaagggacagtgacacaccaggaggatacccagatgctggggggccttgggacagagtctgggaggattgagtgaaggagcaggtgagggtgagcctggagagagaacgccctggtggagagtttatgtagaaaggggattaggtctccgggaggaaccggatccatgtggtctgctgagatggctgagtctggcattcagatgtgccacccaacagaagaggccctggagggacgccccctttgctgggtggcagccgtgggattccggggtctgccttggaggtcctggagaggatgtcgtggccctggccctagactcaagctgcctgggtccagttcagcccggccactcctgctgtgggccctagccaggggccttcactccaccgactgctgtgtgtttggtacatggtgtcacccaggccatgtgcttagcaatgtgcctgacagccagtgccggtgtcagccattacagggacacacgtgcctggaggttgaggccacgttctgtcacctaggcccgctcgtggtcctgggctgggccaaacccccctttgaaaggattcctttttgcccctggcataggctctcattgtcctagtgaacagctacatctttttaacaagccagaaaaggccagctggcagtggctctgcctgaaatcccaagactggctggccgaagcaggaggatcacttgaggccagcctggccaaagtaagcaagactctgtctctacaaaaaaataacaaaaaaaaaaaaaaaaactcgag

SEQ ID NO: 67 - DNA, 1322 bp, Homo sapiens
  misc_feature (11)..(11): n equals a,t,g, or c
  misc_feature (690)..(690): n equals a,t,g, or c
  misc_feature (719)..(720): n equals a,t,g, or c
ctragcaactnagtgggatcccccggrrctggcaggaattcggcacgaggtggaatctgtgacccagaagtaacaaactcctttcttggagagcagttaggtattccattccttagtccatatgccaacatttaaaaaggccaaaaccagaggcctagaaaatgtatctggaagttgcagtgagaccgtttttgatcattgtggccttcctggggctcagtttcctcgctttgcaaatgccattttggcagggatctgctgtggggcatctccgtgcaggtggagctggagttgcgcatctttctcaggctggcatcatacaggccccagtgcactctggcagggaggggcagccccctcctggatagccccgsccaaggccgggargactgtgaaggggggatcccactgcctgacctcagcctgtcgggccccacagcgcgtctctctgtggactggtcgccggcttcctgtggcctgtgtgtcctccgagtggctggagctttggaaccctattctgtagcttggagctcctgagcctcaaagggcaggggcctggttccttgcccatccttgcccagcctgatggcctgtgcttgtggactgtacatgggcacctgctttaacacctggaggagtaggggctaccaagaagcatgtggctctgggcctccctgggagagtcactcngcggcaggagaactgagtgggacacatcnnggagtgtctgtctcatggacscctkttggcctgcagcctggagagggggcctgaagtgtgtgttccatgctcttgacccccagkaagcactcgcctctgttgaaagcctcgtgccgcagagcgcgattgctgtcccgggtggacggccatcacgggctccttgctccggcgatgccagcgctcctggtgttgtgtgtggctggctcccccttgtctcagccctgggcttagagcaggccaggtgctcaggcagtggttttgttgcttgaaggggggtgtgtacctggctgcagcctgtggagagcgtgagtggctggcagaagcaaaggcgggctcttgggagatgagagcaggcagccggcctggaggcttccatggggctggtcagctcctgctggctcttcctggcacaaatccacgctgggctgggtgccttggctcacacctgtaatcccagcactttgggagcctgaagtgggaggatcgcttgagcctgggagttcaagaccagcctgggcaacactgtgagaccctatctctatttttaaaaataaaaatataaagataacccttcctycaaaaaaaaaaaaaaaaaactcgag

SEQ ID NO: 68 - DNA, 865 bp, Homo sapiens
  misc_feature (445)..(445): n equals a,t,g, or c
gaattcggcacgagcagacctgggctcgagaccataactgtttggctttaacagtacgtgggcggccggaatccgggagtccggtgacccgggctgtggtctagcataaaggcggasccagaagaaggggcggggtatgggagaagcctccccacctgcccccgcaaggcggcatctgctggtcctgctgctgctcctctctaccctggtgatcccctccgctgcagctcctatccatgatgctgacgcccaagagagctccttgggtctcacaggcctccagagcctactccaaggcttcagccgacttttcctgaaaggtaacctgcttcggggcatagacagcttattctctgcccccatggacttccggggcctccctgggaactaccacaaagaggagaaccaggagcaccarctggggaacaacaccytytcmagccanctccagatcgacaaggtacccaggatggaggagaaggaggccctggtacccatccagaaggccacggacagcttccacacagaactccatccccgggtggccttctggatcattaagctgccacggcggaggtcccaccaggatgccctggagggcggccactggctcagcgagaagcgacaccgcctgcaggccatccgggatggactccgcaaggggacccacaaggacgtcctagaagaggggaccgagagctcctcccactccaggctgtccccccgaaagacccacttactgtacatcctcaggccctctcggcagctgtaggggtggggaccggggagcacctgcctgtagcccccatcagaccctgccccaagcaccatatggaaataaagttctttcttacatctaaaaaaa

SEQ ID NO: 69 - DNA, 1150 bp, Homo sapiens
gcggatcaggagaaaataaggaatgtcaaaggaaaagtaattctgtcaatgctggttgtctcaactgtgatcattgtgttttgggaatttatcaacagcacagaaggctctttcttgtggatatatcactcaaaaaacccagaagttgatgacagcagtgctcagaagggctggtggtttctgagctggtttaacaatgggatccacaattatcaacaaggggaagaagacatagacaaagaaaaaggaagagaggagaccaaaggaaggaaaatgacacaacagagcttcggctatgggactggtttaatccaaacttgaaggaatccgaataactaaactggactctggttttctgactcagtccttctagaagacctggactgagagatcatgcggttaaggagtgtgtaacaggcggaccacctgttgggactgcgagattctcaaggggaaggactgggtctcatttctcccatctcagcgcttagcaggatgacctggtatagagcagggaactgggaaatgtgggtcaggggatcagacactccagttgggtcttttatataaattaaatggcaaaaggctccatacccttctccttctttcctaccctccactttatctgcaaaatgggaatgatgataacacccacttcatagaatggtcatgaagatcaaatgagagaataaaagtcaagcacttagcctctggtgcacaattagtattaaataagtatacctattcctccttttccttttttaaaaataatattaccaaatgtccagcttatacacatttacaagacttagctagtgggctatgttagagctactaaaagatctttgacaagctaaaactaagatgcaatgaatgaggtgtaacgaacaagagagttttaagttcagaaatggttacagaagtataagacagctgtgtgggtgttttttgatttttggtttctggtttacaatctcgtcattcaacaaagatgggagttttatagaactaaaagcaccatgtaagctactaaaaacaacaacaaaaaaggctcatcatttctcagtctgaattgacaaaaatgccaatgcaaataaaaatgattactttttattttaaaaaaaaaaaaaaaaaaaaaaaaaaaaaaaaa

SEQ ID NO: 70 - DNA, 1398 bp, Homo sapiens
gggagataggaatggaattgatggctttattcttcagaactaccaccgtagcagccatggcaagcaggggcgcccttgcgttgttcttgaggaaaatattaagtgaggctaaattcaaactgagcctgactccccaacccccacaacccttttatatatatatggcatattacagtgagaatttctttttaaagttttaggtctttgtctttttcttgataaaattatagttataatagttgtcataagttaatcaatcgtatgttttaagtgcccttagtgcaaaatttgatgcccctggatactgttgatttattaatatgaaatatacctttgttaatttttaattttatggataggtgtatatgtttatggggtgtgagatacaacttactctatttacgttacttaccgcagaaccacatatttcttccaaatgtccatgccctatcttagttacaaaaacacaatcatttgccaagtgaattatcggtgattattagaaatcatttatactgtggttctgtgtgcatttaaactataatatacttagaaattattcttgctttggtaaaatactttccttcttattcaagaggattttttgggtcatgctgtcttgttatatactcttttaagtttattatgattgtgtgtgtatatgtttgttttttctttttccttctgtctgaattctgttgcactgagcaatgttgtaatatttttattttaaatataagtaatatttaaaattactggaaatatgtaaccatcagattattatctcctaatgataaacagaatttgttaattaagctaaacctagaattgtagacaattatttttacattgcatctacattaaaatgctatctcaaacacacatacttggttgtgtaatatttatctactcattaagtagaaagagtaaattaaaaattgcttttggattattgatgagggtggattatactttagaacactttattcaaacagttcttccacatatctcccttttgacttgactgagcaactctctttctgtgcttcggtttggtctctaagtcagagttaatatttcttgctctatctagcatatagaagcattgtgggctgggtgcagtagctcacacctgtaatcctagcactttgggcagattgcccaagcttaggagtttgagatcggcctgggtaacatggcgaaatcccgtctctactaaaaacacaaaaaaattagctgggtatggtggcgcacgcctgtaattccagctacttgggaagctgaggcgcaagaattgctggaacctgggaggcggaggttgcagtgagccgagatttcgccttgcactccagcctggcgagattctgtctccaaaaaaaaaaaaaaaaaaaactcgta

SEQ ID NO: 71 - DNA, 1557 bp, Homo sapiens
  misc_feature (1541)..(1541): n equals a,t,g, or c
  misc_feature (1549)..(1549): n equals a,t,g, or c
gcaaaggtgaagctggttttcatggtctcctgagggcccctggcccctgggagatgggtcacactccctgaatgctgtgctgttggtttccctggaggattcttgctgcaggccaggtcccgtattctccacactcaccacaagtggctgggtgtgacttgacacggtgtgaaagtggaggggcgcgagcactcagtatccagcgagcagcattggtggtcctagaaaattactacaaagatttcaccatctataacccaaacctcctaacagcctccaaattccgagcagccaagcatatggccgggctgaaagtctacaatgtagatggccccagtaacaatgccactggccagtcccgggccatgattgctgcagctgctcggcgcagggactcaagccacaacgagttgtattatgaagaggccgaacatgaacggcgagtaaagaagcggaaagcaaggctggtggttgcagtggaagaggccttcatccacattcagcgtctccaggctgaggagcagcagaaagccccaggggaggtgatggaccctagggaggccgcccaggccattttcccctccatggccagggctctccagaagtacctgcgcatcacccggcagcagaactaccacagcatggagagcatcctgcagcacctggccttctgcatcaccaacggcatgacccccaaggccttcctagaacggtacctcagtgcgggccccaccctgcaatatgacaaggaccgctggctctctacacagtggaggcttgtcagtgatgaggctgtgactaatggattacgggatggaattgtgttcgtccttaagtgcttggacttcagcctcgtagtcaatgtgaagaaaattccattcatcatactctctgaagagttcatagaccccaaatctcacaaatttgtccttcgcttacagtctgagacatccgtttaaaagttctatatttgtggctttattaaaaaaaaaaraaaaatatatagagagatatatatctatgccagaggggtgtcttttttaaaaattcttcttcattgctgactgaaactggcagatgattgaccagtatcctttgaccatctgcactttatttggaaggaagcaggggctgtccaccctgaaaaagagtgactgatgacatctgacttttgtcgatgggacttctcaagaagccattccttggagcttctgttacagctgtaaaccaaagtggagctggtgcttcttgggagcctcgccttacaactagttcctgcctttcgtccagtaccaagtcccccgttgcttctggtcagcccacttgtagacttccaggggacacatctttattctgtttcaggaaaccagtcacracacgtccacatatgtatttgtgtatgttaatgccagtatcacatcacccatgaaagtcgtgggcagttcargagatacctgscttcgtctttgktctttgttgccttaggttcttcagagaaagatcmcaacaaaaaatgtacmctgtcgtttacagctawaagngatttganttgttttt

SEQ ID NO: 72 - DNA, 1163 bp, Homo sapiens
ggcacgagctggctgcagggtctctggggagagaaggggcctcggcttcacaggatggggctgccagtgtcctgggcccctcctgccctctgggttctagggtgctgcgccctgctcctctcgctgtgggcgctgtgcacagcctgccgcaggcccgaggacgctgtagcccccaggaagagggcgcggaggcagcgggcgaggctgcagggcagtgcgacggcggcggaagcgtccctactgaggcggacccacctctgctccctcagcaagtcggacaccagactgcacgagctgcaccggggcccgcgcagcagcagggccctgcggcctgccagcatggatctcctgcgcccacactggctggaggtgtccagggacatcaccggaccgcaggcagccccctctgccttcccacaccaggagctgccccgggctctgccggcagctgcagccaccgcagggtgcgctggcctcgaggccacctattccaacgtggggctggcggcccttcccggggtcagcctggcggccagccctgtggtggccgagtatgcccgcgtccagaagcgcaaagggacccatcgcagtccccaagagccacagcaggggaagactgaggtgaccccggccgctcaggtggacgtcctgtactccagggtctgcaagcctaaaaggagggacccaggacccaccacagacccgctggaccccaagggccagggagcgattctggccctggcgggtgacctggcctaccagaccctcccgctcagggccctggatgtggacagcggccccctggaaaacgtgtatgagagcatccgggagctgggggaccctgctggcaggagcagcacgtgcggggctgggacgccccctgcttccagctgccccagcctagggaggggctggagacccctccctgcctccctgccctgaacactcaaggacctgtgctccttcctccagagtgaggcccgtcccccgccccgccccgcctcacagctgacagcgccagtcccaggtccccgggccgccagcccgtgaggtccgtgaggtcctggccgctctgacagccgcggcctccccgggctccagagaaggcccgcgtctaaataaagcgccagcgcaggatgaaagcgaaaaaaaaaaaaaaaaaa

SEQ ID NO: 73 - DNA, 1486 bp, Homo sapiens
cggcacgagccagggctgaggtaggagggagtctgtccctcgacgcctcctgcgacgccagcccctgagcgatgatgcgaacgtgcgtcttactctccgcggtgctctggtgcctcacaggagtccaatgcccgcgttttaccttattcaataagaagggcttcatttatggcaagacaggacagccagacaaaatatatgtagagttacatcaaaatagtccagtccttatctgtatggattttaagctttctaaaaaagaaatagtggaccccacctacttatggattgggcctaatgaaaagacgttaacaggaaataatagaataaatataactgaaactggacagctgatggtgaaagattttttggagcctttgtctggactttacacatgtactctttcttataagactgttaaagcagaaactcaagaagaaaaaacagtcaaaaagagatatgactttatggtctttgcctatcgggaacctgattattcatatcagatggctgtacgttttaccacaaggtcttgtatagggagatacaatgatgtattctttagagtgctgaagaaaatcttggatattctaatttctgatttgtcatgccatgtcatagagccatcatataaatgccattctgttgaaattccagaacatggcctcatacatgagctatttatagcatttcaagttaatccttttgcgccggggtggaaaggtgcttgcaatggatctgttgactgtgaagataccactaatcataatatcctccaggcaagagatcgaatagaagacttttttcggagccaagcatatattttctaccataactttaataaaactctaccagcaatgcattttgtggaccacagtttgcaagtagtacgtctggatagctgtcgaccaggctttggaaaaaatgaacgtctacacagtaattgtgctagctgttgtgtggtttgtagtcctgcgacttttagtcctgatgttaatgtaacttgtcagacctgcgtttccgtccttacctatggagctaaatcttgcccacaaacttcaaacaaaaatcagcaatatgaagattagaggtgaaagcattgttacttacttgtggaagtcggggacataagatgatcttcacatcccagagcatcatagatagttccattaagtaaaatcagtaagaccaaaccactgggaaaacatgcattttggaaactttaaaataaaatgggttaacatggcatttctaagaaggcatttaatccggtatctctagtgtacaaaggaaacttgaagttttcatggattatttttaatgaaatgttttattgtttacaaacggtatgttgctgtgtacctaagggtttagtaaggtcaagaagggtttcaaagtttaataaaataaaaattgtatactctccaaaaaaaaaaaaaaaaaaaaaaaaaaaaaaaaaaaaaaaaaaaaaaaaaaaaaaaaaaaa

SEQ ID NO: 74 - DNA, 1553 bp, Homo sapiens
ggcacgaggggatgcagcagagaggagcagctggaagccgtggctgcgctctcttccctctgctgggcgtcctgttcttccaggtgagtgctccggctggctacgctccacttccggccggggggttagggaagatggtcgcttttccggttccgggtaggggggtctccagaaagcccccgcatagctctgggaaggaaggagggagggagcgggacgttgggacgatgtcatcaccaccccgttgaggatagttggtattttgtcagtcctttcctgagccttgggagctttttcaccttgcgtgacctgtcattgtatttggtgatacatacttgatggaacacaaatagctctggctttgggggcacccggtgttattttgtggtgttattatcagtggttgaccgctgtcgtttgggcgctgtataccctgattagaaagaaaacagttctagcattcagtagtttgccccagtagttttgggaaacaaaatcatgacagttggtaattttattttttgtagtgattattgtagtctataaaatgaaatatttgctaatcacagaaaggatgtgatgtgattcgttatagaaaaacatatcgatgaaaaagtactgctttagcatttcataactttttttaatacaagaaagagcatataaattctgttaaaatttattaagtaatatcagaagtagggtattcacactgacattcacatcttaaaattaggtgagttttgctttcatataattttcagattgcataaatttcaatccagcctaattaccttcatctcaaggtacaattatttcctggattttgtgtatgtgtgtcttcctgggaaataaaatattagtatatctagtattagagtgaattgctaaatttataaaatttccttgagggtaatggggatttctgaaagagatatttaatattatataaatataaagactttaatataaagacttcagatgtcctaaatcttagcagttaaggctggaaagtttttaactgttgactaatattcatgttgccagcacacccccgatccctcccagctgcctgtgtcatcataagtctccagtttttaagctaaattactttgcagtatgatatttagctggcctactgtcactcctaataaacccagtcctctctctctctctttctcacacacacacacacacacacacacacacacacacacacacacacgagaaatattcaaatattgtcttattgagaaaaaaaatctggaaatggtgttttcttaaatctaatgtcatgttgctttgaagagcatctgtcaagtccagcagaccatataattcaatcaaacatttaaagttgattttacaatctctatgtacttgtggaatagattttttgccttttaaaaaataactggtggcagggtgtggtggttcttgcctgtaatcccagcactttgggagaccgaggcagctggatcacctgaggtcaggagttcgagaccaggctgaccaacatagtgaaactccgtctctactaaaaaaaaaaaaaa

SEQ ID NO: 75 - DNA, 1650 bp, Homo sapiens
ggaacctcatcaacgctgacttctgcgtggcctctgtctgcgtggcctttggggcagttctgggtaaagtcagccccattcagctgctcatcatgactttcttccaagtgaccctcttcgctgtgaatgagttcattctccttaacctgctaaaggtgaaggatgcaggaggctccatgaccatccacacatttggcgcctactttgggctcacagtgacccggatcctctaccgacgcaacctagagcagagcaaggagagacagaattctgtgtaccagtcggacctctttgccatgattggcaccctcttcctgtggatgtactggcccagcttcaactcagccatatcctaccatggggacagccagcaccgagccgccatcaacacctactgctccttggcagcctgcgtgcttacctcggtggcaatatccagtgccctgcaaagaagggcaagctggacatggtgcacatccagaatgccacgctcgcaggaggggtggccgtgggtaccgctgctgagatgatgctcatgccttacggtgccctcatcatcggcttcgtctgcggcatcatctccaccctgggttttgtatacctgaccccattcctggagtcccggctgcacatccaggacacatgtggcattaacaatctgcatggcattcctggcatcataggcggcatcgtgggtgctgtgacagcggcctccgccagccttgaagtctatggaaaagaagggcttgtccattcctttgactttcaaggtttcaacggggactggaccgcaagaacacagggaaagttccagatttatggtctcttggtgaccctggccatggccctgatgggtggcatcattgtggggctcattttgagattaccattctggggacaaccttcagatgagaactgctttgaggatgcggtytactgggagatgcctgaagggaacagcactgtytacatccctgaggaccccaccttcaagccctcaggaccctcagtaccctcagtacccatggtgtccccactacccatggcttcctcggtacccttggtaccctaggctcccagggcaggtgaggagcaggctccacagactgtcctggggcccagaggagctggtgctgacctagctagggatgcaagagtgagcaagcagcacccccacctgctggcttggcctcaaggtgcctccacccctgccctccccttcatcccagggggtctgmctgagaatggagaaggagaagctacaaagtgggsatccaagccgggttctggctgcagaagttctgcctctgcctggggtcttggccacattggagaaaaacaggctcaaagtggggctgggacctggtgggtgaacctgagctctcccaggagacaacttagctgccagtcaccacctatgaggctcttctaccccgtgcctgcacctcggccagcatctcctatgctccctgggtcccccagacctctytgtgttgtgtgcgtggcagcctccaggaataaacattcttgttgtcctttgtaaaatggtgtgaatgctccaatggggccagtttgagggagaaaaggacccaagagacctgcttctgccccagcccttaccttcatccaagggtaccaaccacactgcga

SEQ ID NO: 76 - DNA, 2150 bp, Homo sapiens
  misc_feature (874)..(874): n equals a,t,g, or c
  misc_feature (1198)..(1198): n equals a,t,g, or c
  misc_feature (1201)..(1201): n equals a,t,g, or c
  misc_feature (1266)..(1266): n equals a,t,g, or c
ccacgcgtccggacccgagctccagtagttccgcccgctggtcatcgcgccctttcccctgccggtgtcctgctcgccgtccccgccatgctgtctctagactttttggacgatgtgcggcggatgaacaagcggcaggtgagcttgtccgtcctctttttctcctggctcttcttgtcccttcgaggctgctgctgcggggcccggcggaccccagggttctggtgtgagggtctgagctggtctgatacccgggtcattcgctttctttggagactgtggccagaggccgccttgtccgcctcattatttttaaccccgaactgattcagggcctacctggggcggggcgggaagcggtgtcttcacgttccattcctcccactgaggcaggggagcaaatggaaaccgtacgcgcttgaagtgggagttggggtgcttattgttttagtcattttaatgcggcggactcttgatttctccagtcggagcgactccaggtggtttcgggagagacgaggtttagccggtttctggggcgctcaggaaggcgattggaggccccacaaaaaccgttttgctgctttcagctccttgcaaccctttagtagagctgaaccgtagcgggctgcaccgactttgacttggaccactctgggctccgagttggaacagttacactacttgcccttgcgtccgcttagcactaaggcggcagccctcggaatctatggttttacagtccaatatcagtgccacggggatctggaaatgtaggtctcctgattttgtccttacactttactttgatcttctagatcgtatgccaaatagtactgagaatattgttgtaattatttagtccttagaaaangttgttctgttttatcttttgcgcctagtgtgtctgtagagcctagttttgctgcatcggactttttttttgttttaaacagtattttactgttatgattatcctgatgtcaccattaaggattttttttttccttggacttgcattttttgtacttataactgccacttagggaagtagatacacaacctttccttactccccttcaggccttagctagctcagtgtcaattctgtcagtcagaattgagcattctataaaaattgcgcaaacgttactttatgtctttatgacaacacttcaaatttttacttgtatagtgntgnctttttttaatccatatttggatttctagatgccacagatatttctctgaggaaagtatttattntgagtctgatatttattgactctatgctaggtccaatgagagaaatgcaaagatagttaagaaagactcggccttcaaggagcctaaatgtgtagaaaaggactaaggcaaaacaataacttttttgagctcttgccatgtgtgaagcactttatacacctgtaaggtaggtaacgttgttcttattaaacatgaagaaaatgagactttgtgagaagcaatacagtatagaagttaagaatatggactctaaagctagatttcagaggtttgaagtagctctgctacttactggctgtgtgactttgagcagattacttaacctgtctgtgcctatgtttacttttattgttgtaaaaagatatgcaacataaaatattccatttcaaccgtttttacgtgtatacttcactgacattagttgcattcactatgttgtgcaaacgtagggtcgctatgaagattaaatgagttaattcatataaagccctcagaagagtgtctggcacatggtgagtattggctgtactgtggtcgatgtcattgttagagagctttagtgatttgcttaagacagaaggtagactgggtgcgggtggctcacgcctgtaatcccagcactttgggaggctgaggcaggcggatcacaatgtcaagagattgagaccatcctggccagcatggtgaggccccctctctactaaaaatacagatactagctgggcctgttggcgcacgcctgtagttccagctactcaggaggctgaggcgggggaatcgcctgggaggtggagattgcagtgagctgagatcgtgccaccgcactccagcctggtgacagagtgagactccgtctcaaaaaaaaaaaaaaaaaaaaaaaaaaa

SEQ ID NO: 77 - DNA, 1592 bp, Homo sapiens
cggatttgttgagtgaatgagaatagtcagtcaagactctggattgttgaattttaggtgctgctcattgtccctcttttatcttcagaaatctcgatgaaaatatacacatagaagacaaaaccgaagaaatattttattatttgttggggcttctctaatttttgtatagctttagtaagctgaattagatggcatggaaccgagaagtttccttctacctgaattgggtgggagagtgtcacacattcctcttggcctcactctggtttttgcctgctttcttatggttagggagactgcaggaggttttagcttcagagcaggagacttagaagaaatctcaagaaagagaacaaatgtattagggtctcttagagggacagagctaataggatatatataatcctattatatatatacacagacacacacacacatatatatatatacacatatatacatatatatacacacatacatgtatatacatatatatacacacatacacatgtatatacatgtatatacacacatatacatgtatatacatgtatatacacacatatacatatatatacatatatatacacacacatacatgtatatacatatatatatacacacatatatgagtttattaagtattaatttacatgatcacaaggtcccataatagagtgtctgcagctgagggcaaggagagccagtccaagtcccaaaattgaagaaattggagtccgacatttgagggctggaagcattcagcacaggagaaagatgtaggctgagaggctagtcctgtcttgccttttcacatttttctgcttgccttatgttcactggaagatgattaaattatgcacactagattaagtgcagatgtgccttccccagcccactgactcaaatgttaatctcttttggcaaaacccaacagacacacccaggattaatagtttgtgtgcttcagtccaatgaaattgacattcagtattaaccatcacaacaaacgtgcatttacattgcatagtgaatgtccttgaacttgttcagtccagtttcaggtgtcttatttcttgggggtagaataagaaaagcagagagaagtcttcttttcccttggagcactggttctcagatacttttattttctagcctcttatggggtaataataattaaaatggagaaaaataaaataatagtaaaatttgaaacaatgcaaaaaatgtaaaaacgaaattactgaaaaaagggcccccattcgccagaagtaggcaggtggctcccagaggtgggcagagcttaggctgaaggaggcgggctgagctgcacctggggtggagagggcctgagtccactcctagttaaggtctgtcaaacccatctgcaccgctcatctgccgcaggggaggctgtgagggggcagaagcagctcctctccctgagggctagccatctggagggagacctacagacctaatgtttatgctgcatgctggaatagaaggaatcgtgtggtgctgagggaacctgtcccctaacccagaccagaggaggtccggaattcgatatcaagcttatcgatacc

SEQ ID NO: 78 - DNA, 1579 bp, Homo sapiens
  misc_feature (1529)..(1529): n equals a,t,g, or c
  misc_feature (1556)..(1556): n equals a,t,g, or c
  misc_feature (1569)..(1569): n equals a,t,g, or c
ggcagagggaacccacgcggaggaaggaagagacgcaggcaggctgcggttacccaagcggccacccgggcctcagggaccccttccccgagagacggcaccatgacccagggaaagctctccgtggctaacaaggcccctgggaccgaggggcagcagcaggtgcatggcgagaagaaggaggctccagcagtgccctcagccccaccctcctatgaggaagccacctctggggaggggatgaaggcaggggccttccccccagcccccacagcggtgcctctccaccctagctgggcctatgtggaccccagcagcagctccagctatgacaacggtttccccaccggagaccatgagctcttcaccactttcagctgggatgaccagaaagttcgtcgagtctttgtcagaaaggtctacaccatcctgctgattcagctgctggtgaccttggctgtcgtggctctctttactttctgtgaccctgtcaaggactatgtccaggccaacccaggctggtactgggcatcctatgctgtgttctttgcaacctacctgaccctggcttgctgttctggacccaggaggcatttcccctgggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaatatgtgccctggctccatgcagtttatgcagcactgggagcgggtgtatttacattgttcctggcacttgacacccagttgctgatgggtaaccgacgccactcgctgagccctgaggagtatatttttggagccctcaacatttacctagacatcatctatatcttcaccttcttcctgcagctttttggcactaaccgagaatgaggagccctccctgccccaccgtcctccagagaatgcgcccctcctggttccctgtccctcccctgcgctcctgcgagaccagatataaaactagctgccaacccagcctgtggccaggtcactgtctaccccagcccagcccagccctctgccgcttgtacatacgccatggggaccctgaggaactgaggccacgtcaatccctgtgccgccccattcgcccgttacatcttccaaactgggacggtcaaggctgaaggctcctctgggtttgagggtccaagggacaaggaggagaagcctagcaggatttcagatgcaggagagagacccaggaagcccggcagagcctgagccccaytgcaattyctyctagggstgcacawtcatgtggcyttagggcamaytgtyctgcatccagtctgtgtyctyctgtctttctcatccaggtcaggcattgacatttgtaagaaanggggtaagggacacagctgggcaagtngattggttggcangattgctgtc

SEQ ID NO: 79 - DNA, 1396 bp, Homo sapiens
ggcacgagaaaaatatgaagtgcacagctgtgtttgcaccatcagcatggccaaacaccctttctcttctcgtttctctccacacagtgatgtgcattaactggcacctggtttctgcatcacacatgcatattgggagaattgttattctagaaggggatggaatgtgacacacctcagataattgctctgagaaatgagtatgaggtctttttaaaaaaactttacatttaaacacacaaaccatttaaaaaaaccactcctccaaaacagacacacaagtgaaacaaaccaaatcgactgtccatccatttaattttgaactatctgcaatatcaccttaaagctctaagctcctaatgattttggtcattacaaatccaaaataacattatttcaaaatgaagttttactatgatttttcccatttgggaaacagtatatccaatacaacaagatgcatgtgtacctccattaaaattttaacaattaggaaaattagaatttatatatgatagattaaaatatgattatttcctaaaagttttctttagttttacaggtttgcttctggattgctttcaatagttattagtgaatttaaaatttgattcagtatgaaggtaatgtacacccatcttcttcagaacacgtattttaaaatgtgacatcatctgttctgagtctaagcactgaagaatgaagtgtccacattcaccgtatttatgcacagacacattctcattccattgacatttaagtgatgtaatgaactaaaactgccacaaagagaggagggttgggaggctgagctctggacagctctgtcactgggcaagtaacatggtgtttagaaaatctctgctcctttctgtgccattggtctatatctctgttttggacaaaaaaccaaacaccgcatgttctcactcataggtgggaattgaacaatgagaacacttgcacacaggaaggggaacatcacacaccggggcctgttgtgggatggggagagcggggaggaatagcattaggagatatacctaatgtaaatgacgagttaacgggtgcagcacaccaacatggcacatgtatacatatgtaacaaacctgcacattgtgcacatgtaccctagaacttaaagtataataaaataaaaataaaaattaagtaaagtaaaataaaatctctgctcctgtttgctgtccccactgataaaatggtagagcagatcactcctaagtcagagcttgtgtaatagctgcgtaggagtgtgaaaccaggctacttgggagccagtgctggctccagaactttccagctgcgtgtccttgggkcaggtggtttacactctgttgcctcagtttctccagcaataaaaaaaaaaaaaaaaaa

SEQ ID NO: 80 - DNA, 1230 bp, Homo sapiens
  misc_feature (1223)..(1223): n equals a,t,g, or c
cagcaccatcgcctacctgacctcccagctgcacgccgccaagaagaagctcatgagctccagcgggacctcagatgccagcccgtcagggagccccgtgctggccagctacaagccagcgccccccaaagacaagctacccgaaacgcctcgccgccgcatgaaaaagagcctctcagcccccttgcacccggaatttgaagaggtctacagattcggggcagagagcaggaaactccttttgcgggaaccagtggatgctatgcccgaccccaccccatttytgctggctagggagtccgccgaggtccacctcatcaaagagaggcccctcgtcatcccccccatcgcctccgaccgaagcggcgagcagcacagcccggcccgcgaaaagccgcacaaggcccacgtcggggtggcacatcggatccaccacgccaccccgccgcagccagcccgaggtgaagaccctggcggtcgaccaggtgaacggaggcaaggtggtgaggaagcactcagggacggacagaactgtgtgaagcccgccgtgccccaccccgcgctgtccatgcactgtgagcaccactgggaaatctcagccacaccttttctgtttaatcccatgcatgccaaacacttttcacacctaccgacccattctccttctgcttctcttgccctcttcttcacaccaaaatatgatcgtgtccctgccgcagaatatgtatttcctaattgctgtggccaaacgcctgtgtgccgaatcgcttgcttctgatcccgctccgtgtaacctaagtgcgctgcaggcaaagcccaggccacggctgcgtcactactgatgttcacgatgccacacagtcacacacctaattcattctcaagtcggagcaacacataccaaccttgaccttatcctcaagctccagggcagcctggccgagcagcccctgctccctcctggagacccttgtcacctcccgagctcctcctggagacccctgtcacctcctgaccaacctttcccagggcggcaccgatcaccgagcagccgtgcgtgtatctcaaggaactaaataagatgacgctactcctcatagcaccacaacctgaatgtgtgttcatatttttttgttagttttatccaaaatgtttaagatcccaacaaactttattttctaaacctgcaaaaaaaaaaaaaaaaaaaaaaaaaaaaagggggnccccttt

SEQ ID NO: 81 - DNA, 1139 bp, Homo sapiens
acgcgtgggtccggacgcgtgggcggacgcgtgggagcaagcccaggcggcggtggaaaggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctscacctgagcctcaccctgctgttgagccctgagtggctaggggaaatgggaagaggattgccatggcctggccatcttgttgctgcttggttagatcatatagctaatgaattaggcaggggagctattttttgaagatgatgaactaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtggcaaatacattccccagcaggccttttgttggttgcactaactgcaaggttgctgggaagtagagtccatttggttgatgagctttgactgcggttttggaaccttacctctcctccttagcccaatatgctgtcttgggtcctattcaaataaagttatttctcctggtcwmaaaaaaacggcacgagcggcacgagctacgtggg

SEQ ID NO: 82 - DNA, 1409 bp, Homo sapiens
ggcacgaggaacctcccgcgggctttggactgaggtccctgtggcgtcggtctcctccccatgaagtgggagcgaggctccccaatggtgcttttggctttagtgtacgatgtttgctgtgcttcccgccgtggagggcagagccaccccacatcaggatcggacgtgctacccctcccggtcccggccctggcccagccagcccagccctcgaggctcgatgcctgtgccaaggccaggggcagccagagggcagctggatggccacgtgcagggtcaaggctgggccctgcagtggggcgggccgccagccccagcagtttacagacgcatggctcttcctcccagagcagccggcagctacctggaccggaaatgtcctcatcccctccctggggccaggctctgccctggccttcctctgtgaacccctcctttctttgtgctgtctcgggactcctgaccgtggtgtgcgtgtgtgcccgtctgtgactttctactcaccaagggttgaagaaaggaaacggggaaaatcaaaaggggttcaaaccccacctcagtaggtggaggggagcgcctgccattggttgtatttttgttctgagttttcggtgccgtgttcctaactactccatcccatgacctcgccacacctactggggcatctggctggtgcctgctgccatggccagcccccactctcaccctgcacagggggtcttgcagcccccaggcccacagcctcgttgggaggacagggtggccctggggacaagagggaggagcccaggggcttacctcactgagagtgctccccagcaggcatccactaccccagggccccccacatgtcatggcaaggttggtagtgaatgggcctggttgggagcagcccctggcccattgcccacccacccatctcactatgcaattcgagttccaagcaacatttgctcctgccctggggccagctctgccccagccctgagaggggtggtgaggcagccccctggaccccagaaccccagacaagggggcaggcgggggaccagggcctctcctgtgggatctttgttttgtgtttaaccataatggttgtgtactgaaccacttcatatttgttatatataatatatatatatataatctccttaagactcagcctcctggtttacccccccggcctgggcatctgacctccagcctctgtagggccatggctgtatgtactgtcgctgtgtttttttgtttttttagaactgggtttgggggctgatttttatttctttgggggctttttttcttggcaaatactaaaaatctcgtcaatgtaatttctgtggtttctattcagcttgggtttcatgttttaaaataaattttaaaaagcaaaaaaaaaaaaaaaaaaa

SEQ ID NO: 83 - DNA, 714 bp, Homo sapiens
  misc_feature (704)..(704): n equals a,t,g, or c
  misc_feature (709)..(709): n equals a,t,g, or c
  misc_feature (714)..(714): n equals a,t,g, or c
attcggcacgagaccaaagagaggcttgggacagaccctaccctctcagtcttcacaggacaacaaccctgcccgcaccttgatcttggacttctagcttccagagctgtgagaaaataaatgtctattgtttaagccatccagtttgtggtactttattacaacaaccctagcaaactagtacaaagggcatgcaattcattctcactggaataacactgtctgggtatttgtttaccttttctgcctgtgcagtgctatcagccagcatcactgtctggggtcttatggagtgcctgattcacaggcatggatcccacacaacagagcatctgaccaggacacttacttcacagcaaagctccagaggtcacctgtccctatcacacagcaccacccaaagtaatcaacctgaaagaacattagcactgcttactggaggaacagctgacttatcggtttggaggcaacactctccaaagatgggtgccatcttccaagatgctgtatttgcacttgactcacaggcctatttatggggcattgtttctaatagggagaatatatgggtcctggaacaatggcccccacccaaggggttccattcttgccaggaaacaccgcaagagtcccattgaggctgggcgtggtggtacacacctgtaatcccagctactcgagagtaccttctaggagcgggcggngggcncatcn

SEQ ID NO: 84 - DNA, 1097 bp, Homo sapiens
ccacgcgtccgggcgctgctttttgcacgttctttgcgcttgtgccgctggggagccaaacgattgggagttgcctccacagaggcccagagaggcgtcagtttcaaactggaagaaaaaaccgcccacagcagcctggcactcttcagagatgatacgggtgtcaaatatggcttggtgggattggagcccaccaaggtggccttgaatgtggagcgcttccgggagtgggcagtggtgctggcagacacagcggtcaccagtggcagacactactgggaagtgacagtgaagcgctcccagcagttccggataggagtggcagatgtggacatgtcccgggatagctgcattggtgttgatgatcgttcctgggtgttcactatgcccagcgcaagtggtacaccatgttggccaacgagaaagccccagttgagggtattgggcagccaagaagtggggctgttgctggagtatgaggcccagaagctgagcctggtggatgtgagccaggtctctgtggttcacacgctacagacagatttccggggtccagtggtgcctgcctttgctctctgggatggggagctgctgacccattcagggcttgaggtgcccgagggcctctagtatgtccattactggagtccctaatcacgcctttggccagcctccttttgaaagtgtccgaagcctttttactttgcctcaagcaacctctagctcccacaattcagtgttgggtcctctgtgcaatatcatgatcatcttcctcatcccctaccttgtgaaagctaggcatacagccaaaccctccttttccccacccaccaacactactgccaatttcctaggctaccatgggtgtatcttccttgacctgcttccttcagtccctctgcctccctttgcccaggcctttctcagactgtattccatcctggggtcttatcattcagctttgtttgaatttattaatcaccatgatacctctccctccctttgtccacatgtaacttgttcttggggctctaccagatggctgaagagtaaatcctttctacctctgaaaaaaaaaaaaaaaaaaaaaaaaaaaa

SEQ ID NO: 85 - DNA, 1931 bp, Homo sapiens
  misc_feature (1904)..(1904): n equals a,t,g, or c
  misc_feature (1914)..(1914): n equals a,t,g, or c
  misc_feature (1921)..(1921): n equals a,t,g, or c
ggcacgagcggcacgagcggatcctcacacgactgtgatccgattctttccagcggcttctgcaaccaagcgggtcttacccccggtcctccgcgtctccagtcctcgcacctggaaccccaacgtccccgagagtccccgaatccccgctcccaggctacctaagaggatgagcggtgctccgacggccggggcagccctgatgctctgcgccgccaccgccgtgctactgagcgctcagggcggacccgtgcagtccaagtcgccgcgctttgcgtcctgggacgagatgaatgtcctggcgcacggactcctgcagctcggccaggggctgcgcgaacacgcggagcgcacccgcagtcagctgagcgcgctggagcggcgcctgagcgcgtgcgggtccgcctgtcagggaaccgaggggtccaccgacctcccgttagcccctgagagccgggtggaccctgaggtccttcacagcctgcagacacaactcaaggctcagaacagcaggatccagcaactcttccacaaggtggcccagcagcagcggcacctggagaagcagcacctgcgaattcagcatctgcaaagccagtttggcctcctggaccacaagcacctagaccatgaggtggccaagcctgcccgaagaaagaggctgcccgagatggcccagccagttgacccggctcacaatgtcagccgcctgcaccggctgcccagggattgccaggagctgttccaggttggggagaggcagagtggactatttgaaatccagcctcaggggtctccgccatttttggtgaactgcaagatgacctcagatggaggctggacagtaattcagaggcgccacgatggctcagtggacttcaaccggccctgggaagcctacaaggcggggtttggggatccccacggcgagttctggctgggtctggagaaggtgcatagcatcacgggggaccgcaacagccgcctggccgtgcagctgcgggactgggatggcaacgccgagttgctgcagttctccgtgcacctgggtggcgaggacacggcctatagcctgcagctcactgcacccgtggccggccagctgggcgccaccaccgtcccacccagcggcctctccgtacccttctccacttgggaccaggatcacgacctccgcagggacaagaactgcgccaagagcctctctggaggctggtggtttggcacctgcagccattccaacctcaacggccagtacttccgctccatcccacagcagcggcagaagcttaagaagggaatcttctggaagacctggcggggccgctactacccgctgcaggccaccaccatgttgatccagcccatggcagcagaggcagcctcctagcgtcctggctgggcctggtcccaggcccacgaaagacggtgactcttggctctgcccgaggatgtggccgttccctgcctgggcaggggctccaaggaggggccatctggaaacttgtggacagagaagaagaccacgactggagaagccccctttctgagtgcaggggggctgcatgcgttgcctcctgagatcgaggctgcaggatatgctcagactctagaggcgtggaccaaggggcatggagcttcactccttgctggccagggagttggggactcagagggaccacttggggccagccagactggcctcaatggcggactcagtcacattgactgacggggaccagggcttgtgtgggtcgagagcgccctcatggtgctggtgctgttgtgtgtaggtcccctggggacacaagcaggcgccaatggtatctgggcggagctcacagagttcttggaataaaagcaacctcagaacaaaaaaaaaaaaaaaaaaaaagggcggccgncctaaaaggntccaagnttacgttacg

SEQ ID NO: 86 - DNA, 1092 bp, Homo sapiens
aggccatgacctccctcaggatgcctggctgcgctgggtgctggctggggcgctgtgtgccggtggctgggcagtgaactacctcccgttcttcctgatggagaagacactcttcctctaccactacctgcccgcactcaccttccaaatccttctgctccctgtggtcctgcagcacatcagcgaccacctgtgcaggtcccagctccagaggagcatcttcagcgccctggtggtggcctggtactcctccgcgtgccacgtgtccaacacgctgcgcccactcacctacggggacaagtcactctcgccacatgaactcaaggcccttcgctggaaagacagctgggacatcttgatccgaaaacactagaacaagagtgtggcaaagaacacccgtgctggggtcgggacgaggttgaagggtcttggtcaatgtacgtaatgagcagggtgggccccacgctgggaggacacgggctgggctgagcagggcctctagtggaacacatgggggtctcattgaaaagctctctgatgagcacctccttttgtgcaaagttaattttttctcgacaataaagatattccgtgtcttcacccctgaactaagacacagggagtatttcagaaggccaagcgtaggagtcatcgacaacgaaaaagccgagaacccagggccagcagttggagccttcagcagaaccagggcctggtccttgctaattgctgcagggtggagtttgatctggcagacccgatcctccttcatgaacacccagcaacctgagcaagtcccggccctgccctcagcgagcccggcaggcgtcccgggacagctcagtgttggagggccacctgaaccacgagccagggctggggcttgcatgtcattgtctatgacagcgtcaagactggcccttggcaccgtgctgtgtggaaaccctcccctctgagactccactgagacgtggctgagtgaaatcttcctcgtcagtggtcaaggtgtgtcatccatacagctccatgcctttgtcttttttaaatgtaattaaaaaaggaaccaactggaaaaaaaaaaaaaaaaaaaaa

SEQ ID NO: 87 - DNA, 578 bp, Homo sapiens
  misc_feature (576)..(576): n equals a,t,g, or c
gggacatctgccggctggagcgggcagtgtgccgcgatgagccctctgccctggcccgggcccttacctggaggcaggcaagggcacaggctggagccatgctgctcttcgggctgtgctgggggccctacgtggccacactgctcctctcagtcctggcctatgakcagcgcccgccactgsggcctgggacactgttgtccctcctctccctaggaagtgccagtgcagcggcagtgcccgtagccatggggctgggcgatcagcgctacacagccccctggagggcagccgcccaaaggtgcctgcaggggctgtggggaagagcctcccgggacagtcccggccccagcattgcctaccacccaagcagccaaagcagtgtcgacctggacttgaactaaaggaagggcctctgctgactcctaccagagcatccgtccagctcagccatccagcctgtctctactgggccccacttctctggatcagagaccctgcctctgtttgaccccgcactgactgaataaagctcctctggccgtttaaaaaaaaaaaaaaaaaaaaaaagggggncc

SEQ ID NO: 88 - DNA, 699 bp, Homo sapiens
  misc_feature (661)..(661): n equals a,t,g, or c
  misc_feature (694)..(694): n equals a,t,g, or c
  misc_feature (696)..(696): n equals a,t,g, or c
tcgacccacgcgtccggaagcccccaacagccacgctcaccactgctcggacgaggccgaccacagacatgagtgcaggtaagtggctcctgctggtgatcttcagggatttgggatgcggagtttccaggacgtctccgcacttgaggagtggagaggagggaaggatctggagcctactcacagcctgctcctgctgttgcctcttcgtgatcttctagtggttcttggcgaaatcaggaaaaggcagatggagggttgtgtatggaaagggtggggatggaatccggagaaatggtttgcggtcttggctctgcctgtaacaacccgagtgaccttgggcaagtccctgtccctctctgggsctcagtttctccacctgtatttggaragggttggaatgggcactgaagtcctgtccagctctgaccttctgtgaagtgcactgttgagcagctctggaagcttctgttccagccatagccacacagaggagcagcaggcaggcatcaggcccaaactgctgctctctgatgggcttggaccccatgaaagtggggcctgctggatgcatttcctgggattctgtggaagctgatcaggttgctggggcaagtggaggcaggatagaagtgaagggctgtgggatggagaacctcanaagactccatctggggtccgggaaaggacagananggt

SEQ ID NO: 89 - DNA, 1126 bp, Homo sapiens
ggcasagccaaccctgaggactcagtgtgcatcctggaaggcttctctgtgactgcacttagcattcttcagcacctggtgtgccacagcggagcagttcgtctccctattactgtcaggagtgggggcagattctgctgctggggaaggaaacaggagcctggttcacagyttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtgtggctcctggctaagcttggtgtgcaagagccccttgcccccagtcactggctccaactgccagtgtaatgtggaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactggaaaaaaaaaaaaaaaaaaactcgag

SEQ ID NO: 90 - DNA, 1037 bp, Homo sapiens
agggttgatgggttatggtcaggagtcccagctgggcccaccacctcctcaggaaggcgggtgaggttggtgtgagactgacggtgcctcctcatgtccccttggagcgccccaccccacatctcccggcctcgggtccttgcctggcccagcatgagaggtgcttcataggaacggagggaggacatgtygggacagctcgatgctcggcctgctgctgctctgcacccccagggcctggctcaccctctctggacctgtctgcttccaaggaaggggaccctctgaggtcccacagaggccaccccagytgtgggtcgtgagcatctctgtcttgcagggacagcatcgtggccgagctggaccgagagatgagcaggagcgtggacgtgaccaacaccamcttcctgctcatggccgcctccatctatctccacgaccagaacccggatgccgccctgcgtgcgctgcaccagggggacagcctggagtggtgagtggcctccctgctctgggccagcccagggaggcaagtgccccctgccacatctccaggctgcgcacggcctcgctggctgtcgtcatgggagcagagaaaggtggtgctgaaatgaggccctggcctgctgtccaggctccagctcccctgcccagtgtgggaggcactcccatctgcgcaccaggctgcggatccaaggacacggtgcccargctgcaaccctctgttcccaagggcagagcagaaagcggctttgtctctgctcggtttctgtgtccccaccccccacgaagccttctgtgtctcggccctgggcccagtctctcaggcctccccgggccccccataccggccctcctccagggccctctggggttggggtgctgaagccctgcaaggttggtgcccccctccaccctaggatgtgactccgggccatgtccagggcactggtcacagaaagtgtgtcagttcttccccgtgagctgtccctgcagtgcctgccttccactgtgagttgcaagctgggcatttcatg

SEQ ID NO: 91 - DNA, 1316 bp, Homo sapiens
ggcacgaggcctggcgcgctgcggcgtcgctcacccgctcccgaggaagggcagtgggccccgccgccgcctcccaatggcgaggctgcgggattgcctgccccgcctgatgctcacgctccggtccctgctcttctggtccctggtctactgctactgcgggctctgcgcctccatccacctgctcaaacttttgtggagcctcggcaaggggccggcgcagaccttccggcggcccgcccgggagcaccctcccgcgtgcctgagcgacccctccttgggcacccactgctacgtgcggatcaaggattcagggttaagatttcactatgttgctgctggagaaagaggcaaaccacttatgctgctgcttcatggatttccagaattctggtattcttggcgttaccaactgagagaatttaaaagtgaatatcgagttgtagcactggatttgagaggttatggagaaacagatgctcccattcatcgacagaattataaattggattgtctaattacagatataaaggatattttagattctttagggtatagcaaatgtgttcttattggccatgactgggggggcatgattgcttggctaattgccatctgttatcctgaaatggtgatgaagcttattgttattaacttccctcatccaaatgtatttacagaatatattttacgacaccctgctcagctgttgaaatccagttattattacttcttccaaataccatggttcccagaatttatgttctcaataaatgatttcaaggttttgaaacatctgtttaccagtcacagcactggcattggaagaaaaggatgccaattaacaacagaggatcttgaagcttatatttatgtcttttctcagcctggagcattaagtggcccaattaaccattaccgaaatatcttcagctgcctgcctctcaaacatcacatggtgaccactccaacactactactgtggggagagaatgacgcattcatggaggttgagatggctgaagtcacaaagatttatgttaaaaactatttcaggctaactattttgtcagaagccagtcattggcttcagcaagaccaacctgacatagtgaacaaattgatatggacatttctaaaagaagaaacaagaaaaaaagattgacttttctttatcttctatgaagggtctgtaatgaaatctctaaataatttttaaaaattgttcatcaacttctttatgttttattagaaaaaaactgttttaatgtgctttatcataaataaatatcctgacaaatggtattgaaaaaaaa

SEQ ID NO: 92 - DNA, 1021 bp, Homo sapiens
  misc_feature (971)..(971): n equals a,t,g, or c
  misc_feature (1004)..(1004): n equals a,t,g, or c
  misc_feature (1008)..(1008): n equals a,t,g, or c
  misc_feature (1010)..(1010): n equals a,t,g, or c
  misc_feature (1018)..(1018): n equals a,t,g, or c
ggccgcccttttttttttttttttttttttttttttttttttttggccttagtcatcatttcttgaataatacaaataggtaagacaattttacaaaaattgtgctatagaataggatatttgtgactttttagatgaaatattagagctaccccacccagccacagatagcactgtaacactttcttaatagagtataggttcaaattataaagtccacacactggctaaaaagttcaagttcagagtttcaatcaattttcattgtaaggatgaaactgagttttactcaacttgtgtctttttaagagaatgggccacctcccacacatcctttctcttggactttttttaacacttctaatgttctgtatcacgaaatcagatggccaaaacaaaatctacaggtgctttaaaaaagcaagtccccaagtgattgttacccataccaaaatgagaattgctgctataatctgttcttactggamtggccakgccaatcttgggactaggattaaattgcaattaaattckgcagtgtacaaaatttttgtcagtctgyctagaaaaagaaagagaactctttcatggtagagcagttactgtgctcacgttgctttttctaaaaaccaacctactttcaaacaaagaatgaggaaatttgcagtaaattttaaatatgagtcacggaaatattaagataatagcatgtgtgggcaataataagtatgccaagaaataaagagtaatatacaaaacaatcaaacattattacatttggctacgaggttcctaataaacagggcaaaataaatagtgaaatataataaaatcgttatcatctgataaaaggctgcatggtacttttcccaaacgtaatggatgacttcaacacattttcttattaaatatttcaaattgtttcttcatgtgaaaactgtcttattaattgtaaaaaggatgtaacttgnataggcatgctcaacaggggtaagagtaattcngtangngccccctngat

SEQ ID NO: 93 - DNA, 1260 bp, Homo sapiens
  misc_feature (32)..(32): n equals a,t,g, or c
  misc_feature (314)..(314): n equals a,t,g, or c
  misc_feature (356)..(356): n equals a,t,g, or c
  misc_feature (590)..(590): n equals a,t,g, or c
tttttttttttttttttttttttttttttttntttttttttttttttttttttttttttttttttttttttttttttttaaatttcacctgtttcctttattatgtggctacttgaaaattttaaaattacatatgtagctcacactataaaacacagattagaaatattgtatagcactgacctagaaacctccatttaggtaaaacatcttaacccctttggaagcaaaatatgttaaataacagcataaactcccaccaagaaaatcctcaccttcctcctttcaacacatttattatatacagctgtcantgcattgtcaatctgccaaatggctctatgttccaacagggntggagtagtcccctgctcacaccagccttcacaatacttcccatgtcttccctgttaacctctctccacccagcacccaggctcccaactctcctggctgcctccagccctcagctggcaccactgacatgctgtttccagtacccttttcttctttctgcatcctccctgggggacatacatccctcatctcgtgacttcagctgtcacataaattcaaatgtttcagaactntattttttacctcctacatctgtcagtttaaatgtcaggatattttactttcagtaaagccctaaaaagacaaatctatgtacttttaaagaataaaagaaatgactggctgcagctcaaacctacaactgcttgcgaaactctacaatgtctggcagatgctagaaagaaggggatcaagacagagcacacttggcgtggtatgctatctatagaaaatgttaaaataaaattaagtaatctaggtttcctctctttattttctacatctactctctgaagagggcaataaataaggaaatgtcccaaagagggacaaattaagtcccaaaataacacaaaattgggcaaatcccagtcatgaagaaagaacagaggttcttaaattgggacacacagaggcaggtctgcaggtctaggaatctctgaacatatgtgcaaaattctgggtatgtgtgcatatgttatataacaaagcgaagggtccatatagctttcatcgcatttcaaagggtctagcactgaaataaggactactgctatgtgacttaaaaaatgaaactcaggctgggcgcagtgctcacgcctgtaatcccagcactttgggaggccgaggcaagcagatcacctgagacgaggagtttgagacccgcctggccggacgcgtggg

SEQ ID NO: 94 - DNA, 990 bp, Homo sapiens
  misc_feature (4)..(4): n equals a,t,g, or c
  misc_feature (916)..(916): n equals a,t,g, or c
  misc_feature (958)..(958): n equals a,t,g, or c
  misc_feature (971)..(971): n equals a,t,g, or c
gcangagagctaccaagtggccgagctggcttatraccctagggcagtctgcccccaaaacccatctacttggttgtccccagaatgggttggcttgggagaacttgccttgctcactcccatttagactttattagtggagccctcctcttgacttttgcctatttccttgtctttcaggtgtgccctgtgattaataaatggctctacaacctggaccagcatgtggttaaagagttgattagtaagtgctggaggtgggaagggacaggaacactccagaagaaagctcagaaccctccctcaccctttgtatttcatttccccttacctcactctggcacttctcctagaccaaaaatctctttcctgctgaagtagaatggtccctaataataacaaccttaataataaactcagctgacattaactgagggagcccagtgtgccaacatgaagcactgtgcctgcactagcaattgaacgtgcacctttagctaaggacgtgctggtttcaattctattcttgctcccaagcctacagcagctgagatatgaatggaaacttctccaggggagaaaatctgcccaattctgcctttgtcctcccctaaatttgtatgagttaaatgatgggcagaaaattggtctgttttcagcccagacaaacactgcctcctttcagtagtcgctacctcaagcatccaaagttttcatatctgccagaactcaaagcaaaaaatgcaagattgaatctcagcagctcaggcccccagcaggacttcaaacttccaccaccaaaaaaaaaaaaaaaaaaaatgctgaattgaaaggtatatgccttcattcactgaatattcactcgtcctgccaagtgccagatgccaragtttctaaaattcccccaaaggggggnccgggtacccaattcccccctattagtgaagtcctatttacnaattcccttgggnccgtccgtttttaacaacc

SEQ ID NO: 95 - DNA, 1710 bp, Homo sapiens
  misc_feature (1702)..(1702): n equals a,t,g, or c
  misc_feature (1704)..(1704): n equals a,t,g, or c
  misc_feature (1709)..(1710): n equals a,t,g, or c
ccaggaattccggggtcgacccacgcgtccggaaacatttcccatgtcctaagttcttagaagcaattactttagcgttggggagcattgttctaccagacccatttatgcaggggagatgaagcttaaaagacgggatgtggggtgggagtgtgtttcttaagccgaagctgttgcaggctgggggatttttgcattttctttttgttttgtttttgactgcagattctgtacatctgtctgtgggaggagagttgctactcaggacaggatttaagagacacattccagtgacctttaagaatctgcatggcgggaggtccttctccaggagtgtgggttggtccactctgggacccaccacactaagaagggggagatgataaaataacattaaaggaagaatggcctccagcctgcaggttttgttggaaagaaataaaaagggagtcattaagaccataaattcagattgaggcctcttgaaaaggttgatgtgggctagcaacctgcctgtcgaaacagtccttggttcatcagcagtgtgggaaggcagccaaggctcctgcagattcctggcatcgaccttggaaagcctctgcgatacttgtgtgtacgaatacagcagaggacagggaggtccttgttctgtggtctctgtttagtgactgaaacttaaacccaaaggcaagcccagattgtctggccgttcatccccatgctttgataggggttaggaggaaccctttccgtatgaaagacaggccctaytagggyttacaaccaagccaaaggaccatctcttctttcttccacctcccttcamccctgccccgcagcagagccgagatgtgagacattcattgtcacggagcaaggagacaaaggcaagttcaagttgagaagcatatggcagcaaacagaaatgaaaaccatatgtcccagcaaggggaaaagcagtcatttccagattataaaaatcaatgaagtactctccacctaggtcagctgaaattcgagccctcacagtcaggcctgtcagagaagttaagcagaaacatctcggggggacttctaaaatttagtgaagacaaggccttgcaactccaaagaaactttttttcccccccttgaaacagggtcttgctctgttgcccagcctggagtgcagtggtgcagtcacggctcactgcagcctcaagctcctgggctcaagcactatccccacctcaacctccttagtagctgggactacaggtgcacaccaccatgcccagctaaccacagaaactttcatctcttcattttttctttgggcaccattaatacctaagacaggtagaaagggtcccagaaagacaccattggtaatggccgattgccggctgcagtcatcgcccccagatcaggctggtacaggatgccttaaggtgatgagaggtgagggtgcatgaagaataatgagcacagggaagagagaagcaggacaaagtagcagataaaatgccggcaaagcacagatgaatgtcttcaagaagctcttgtatttctctgcacagtgtaaatatccttgctatttcaggatggcggctggcctgctcagtaacatacatgttccaaataaagattttgcatgaaagtaaaaaaaaaaaaaaagggcggccgctctagaggatccaagcttacgtacgcgtgcatgcgncngtcann

SEQ ID NO: 96 - DNA, 781 bp, Homo sapiens
cggcacgaggcagccagtaggggagagagcagttaaggcacacagagcaccagctccctcctgcctgaagatgttccaccaaatttgggcagctctgctctacttctatggtattatccttaactccatctaccagtgccctgagcacagtcaactgacaactctgggcgtggatgggaaggagttcccagaggtccacttgggccagtggtactttatcgcaggggcagctcccaccaaggaggagttggcaacttttgaccctgtggacaacattgtcttcaatatggctgctggctctgccccgatgcagctccaccttcgtgctaccatccgcatgaaagatgggctctgtgtgccccggaaatggatctaccacctgactgaagggagcacagatctcagaactgaaggccgccctgacatgaagactgagctcttttccagctcatgcccaggtggaatcatgctgaatgagacaggccagggttaccagcgctttctcctctacaatcgctcaccacatcctcccgaaaagtgtgtggaggaattcaagtccctgacttcctgcctggactccaaagccttcttattgactcctaggaatcaagaggcctgtgagctgtccaataactgacctgtaacttcatctaagtccccagatgggtacaatgggagctgagttgttggagggagaagctggagacttccagctccagctcccactcaagataataaagataatttttcaatcctcaaaaaaaaaaaaaaaaaactcgag

SEQ ID NO: 97 - DNA, 1113 bp, Homo sapiens
gaagatttgggagcatctgaagagccagaggagttagaggctctgaagcacagtgacttgatgtctaagctgtttctttgttcatccccctggttggcttaaatctaarctgtctctttgcttgtatgatcatagtctcctgtcatcggtttataagattctccaaattcagaatgcgcattgcaaattcctcatggtaggctggtgaaggacttgacaatctgatgataaattactttgtgaacatgaatgaaaaatattgcatcatatattggtgaggagaaagtggagtaaagaaaaatctccatctatacacaatacagctttttaaatgcagcggactttcaaatatttgcatttctacattatacgttttgtttcaacttacgcatttattgttttctttcctttttcttcctcacatgttaatggcccatgtgagaaaaacattcccctgggtaaatagatagaagagatttgtgcaaatgcaagagaaatttcagtgtatctgctatgatttgaatgtgtcccccaacgttcatgtgttgcaaatttgattcccaatgcagtggtgttgggaagtgaggcctaatggaaggtgtttgggtcatgggggcaccgccttcataaatggattaatgccattattgtgggaatgggttccttataaaaagatgagttcagtcccctcttgctctcctctcaccctctctttgcccttttaccataggctgacacagcaagaaggctcttgccagatgctggtaccttgatattggatttcccaggctccagaactaaaaagaatgaatttcttttctttttaaattacccagtctgtggtaaatttatagtagcacaaaacagattaagacaatatgtctttcagatgtcttagcttatttcattggataactgtaagaagagtttactgcttttctttttttgaaattaagaatttagctgaatgctgttgctcacacctgtaattcccgcactttgggaggcggaggcgggctgatcacctgaggtcaggagtttgagaccagcctggccaacgtggtgaaactctgcctctactaaaaatacaaaaaaaaaaaaaaaaaactcgta

SEQ ID NO: 98 - DNA, 1723 bp, Homo sapiens
gaattcggcacgagcgacatgggctccgctccctgggccccggtcctgctgctggcgctcgggctgcgcggcctccaggcggggggtgagtggcggcgccccccggcccattccccggtcccggccccgcctctgaggttcgcgtccccccacagcccgcaggccccggaccccggcttccaggagcgcttcttccagcagcgtctggaccacttcaacttcgagcgcttcggcaacaagaccttcccycagcgcttcctggtgtcggacaggttctgggtccggggcgaggggcccatcttcttctacactgggaacgagggcgacgtgtgggccttcgccaacaactcgggcttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaagttatggggggatgctcagtgcctacctgaggatgaagtatccccacctggtggcgggggcgctggcggccagcgcgcccgttctagctgtggcaggcctcggcgactccaaccagttcttccgggacgtcacggcggactttgagggccagagtcccaaatgcacccagggtgtgcgggaagcgttccgacagatcaaggacttgttcctacagggagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcagggctggtctacaacgcctcgggctccgagcactgctacgacatctaccggctctaccacagctgtgctgaccccactggctgcggcaccggccccgacgccagggcctgggactaccaggcctgcaccgagatcaacctgaccttcgccagcaacaatgtgaccgatatgttccccgacctgcccttcactgacgagctccgccagcggtactgcctggacacctggggcgtgtggccccggcccgactggctgctgaccagcttctgggggggtgatctyagagccgccagcaacatcatcttctccaacgggaacctggacccctgggcagggggcgggattcggaggaacctgagtgcctcagtcatcgccgtcaccatccaggggggagcgcaccacctcgacctcagagcctcccacccagaagatcctgcttccgtggttgaggcgcggaagctggaggccaccatcatcggcgagtgggtaaaggcagccaggcgtgagcagcagccagctctgcgtggggggcccagactcagcctctgagcacaggactggaggggtctcaaggctcctcatggagtgggggcttcactcaagcagctggcggcagagggaaggggctgaataaacgcctggaggcctggcmaaaaaaaaaaaaaaaaaaaaaaaaaaaaaaaaaaaaaaaaaaaagggcggccgc

SEQ ID NO: 99 - DNA, 2087 bp, Homo sapiens
  misc_feature (56)..(56): n equals a,t,g, or c
tcgacccacgcgtccgtggggccgagcgccgctgggtaggcggaagtagccgcagnatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccatcagacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacaccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctacggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtgrwwaaaaaaaaaaaaaaaaagggcggccgctctagaggatccctcga

SEQ ID NO: 100 - DNA, 751 bp, Homo sapiens
  misc_feature (663)..(663): n equals a,t,g, or c
  misc_feature (702)..(702): n equals a,t,g, or c
  misc_feature (705)..(705): n equals a,t,g, or c
cggcacgagctttttctggtattccaataaattgtaggttcagttttttttatgaagtcccatatttcttggaggctttgttcattgcttttaattcttttttctctaatcttgtctgcatgctttatttcggcaaggtggtcttcaaactctgatatctttttttctgcttggtcgattcagctattgatacttgtgtatgcttcatgaagtccccatgctgtgtttttcagctccatcaggtcttttatgttcctctctaaactggctattctacttagcaattcctctaaccttttgtcaaggttcttggcttctttgtgttgggttaggacatgatcctttagctcagcatagtttttcattacccatcttctgaagcctacttctgacgttgcgatcatttggaggagaagaggcactctggtcttttgggttttcaaaattttttcattgtttctttctcatctttgtgcatttgtctagtttcggtctttgaggccgctgaccctgggatggggtttttctgggggctttttgttgttcttgatgctgttgttgttgctttctgcttgtttgtttttctttcaatggtcgggtccctcttgtgtagggctgctgaagtttgctgggggttcacttcaggtcctattcatctgattnactcgcatgcctggagatgtcacttaagaagcccggatnacngcatagacaggtgcctgctccttcttctgtgatctctgacctcgag

SEQ ID NO: 101 - DNA, 1223 bp, Homo sapiens
gctgctccgtttttcccccatctttgtggttttatctacctttggtctttgatgatggtgatgtacagatggggttttggtgtggatgtcctttctgtttgttagttttccttctaacagtcaggacccgcagcttcargtctgttggagtttgctggaggtccactccagaccctctttgcctgggtatcagcagcagaagctgcagaacagcggatattggtgaacagcagatgttgctgcctgatcgttcctctggaagttttgtctcggagtacccagccatgtgaggtgtcagtctacccctactgggggatgcctcccagttaggctacttgggagtcagggacgcacttgaggaggcactctgtctgttctcagatgtccagctgtgtgctggtagaaccagtgctctyttcaaggctktcagacagggacgtttaagtctgcagaggattctgctgccttttgtttggctgtgccctgccccccagaggtggagtctacagaggcaggcaggcctccttgaattgcggtgggctccaccgagttcgagtttcctggccgctttgtttaccccctcaagcctcggcaatggtgggcgcccctcccccagcctcactgccgscttgcagtttgatctcagactgctgtgctagcaatgaktraggctctgtgggtgtagraccctctgagccaggcatgggatataatctcctggtgtgcgatttgctaagacccattggaaaagcgtagtattagggtgggaatgacccaattttccaggtgccgtctgtcacccctttctttgactaggaaagggaattccctgacccgttgtgcttcccgggtgaggcaatgcctcgccctgcttcagctcaagcttggtgcgctgcacccactgtcttgcacccactttccaacactccctagtgagatgaacccggtacctcagttggaaatgcagaaatcacacgtcttctgcgtcctcacgctgggagctgtagactggagctgttcctattcggccatcttggctccacctgtcgagatattttacattaactttctatgacatacttatagcaaaacttattttttcatgcagaatagtctatattctatatttattgtaaagcatataccgtacatggtgactagtcaccatgctgtacaataaattttctgaacttaataaaaaaaaaawaaaaaagggcggccgc

SEQ ID NO: 102 - DNA, 1010 bp, Homo sapiens
  misc_feature (607)..(607): n equals a,t,g, or c
ggttacttccaagttctgccaactgtgaataaagttgctataaacatctatgtacaggttttttttgtgtgtggacctaagttttcaactcctttgggtgataccaaggagcacagtcactgggacatatggtaaggatatatttagtttggcaggaaaccaccatactgtcttccaaagtagctgtaccattttgcatacccaccagcactgaatgagagttcctgttgctccacattcttgtcagcatttgatgttgtcagtgttctgaatttaggtagtcatgataggtgtgtaatggtatctcactattattttaatttgcctttctctgatgatgtatgatgttgcagatcttctcatatgcttatgtgacatctgtatatctggtgaaatgtctgctaaggtcttascctattttttaatarggatggttgttttcccattgttgagttttaagagttccttatatattttggatatttaaatatactacaaataaacagtcctttaacagataaatgttttgcaaatattttctcttagtctgtggcttctgtctttattcccttgaaggtgtctgtcacaaagcagtttatcttttttnctttttttttttttttgagacgtagtcttgctccagcctgggtggcagagcgarctacgtctcaagaaacaaaacaaaacaaaaaaacacctcagttgcgcggcaaggtkgctcacgcctgtgatcccatcactttgggaggtcggaggtgggaggtgggagaatcgcttgaggccaggagtccatcctaggtctagcttgaccctatctcaacaacaaaaaaataacaattagcccaccgtggtagtgcatgtctgtagtcctagctactggggaggctgaggtgagaggattgcttgagcccatgagtttgaggttacagtgggctataattacaccactgcactccagtctgagtgacagagcaagaccgtgtctcaaaaaaaaaaaaaaaaaactcgag

SEQ ID NO: 103 - DNA, 1986 bp, Homo sapiens
ggcacgagggaaaactgttttatttgcatttgaagaagctattggatacatgtgctgcccttttgttctggacaaagatggagtcagtgccgctgtcataagtgcagagttggctagcttcctagcaaccaagaatttgtctttgtctcagcaactaaaggccatttatgtggagtatggctaccatattactaaagcttcctattttatctgccatgatcaagaaaccattaagaaattatttgaaaacctcagaaactacgatggaaaaaataattatccaaaagcttgtggcaaatttgaaatttctgccattagggaccttacaactggctatgatgatagccaacctgataaaaaagctgttcttcccactagtaaaagcagccaaatgatcaccttcacctttgctaatggaggcgtggccaccatgcgcaccagtgggacagagcccaaaatcaagtactatgcagagctgtgtgccccacctgggaacagtgatcctgagcagctgaagaaggaactgaatgaactggtcagtgctattgaagaacattttttccagccacagaagtacaatctgcagccaaaagcagactaaaatagtccagccttgggtatacttgcatttacctacaattaagctgggtttaacttgttaagcaatatttttaagggccaaatgattcaaaacatcacaggtatttatgtgttttacaaagacctacattcctcattgtttcatgtttgacctttaaggtgaaaaaagaaaatggccaaacccaacaaactaacattcctactaaaaagttgagcttggacatattttgaatttttgtaagtgaagatttttaaactgactaacttaaaaaaatagattgtaattgatgtgccttaatttgcataaatcataaatgtatgtcctctctgtaattgttttaatgtgtgcttgaaatatccagaaaacctatggagttagtaaattctgggctgtcatatgtaggatagccactttttaggtatatgtacatttatatttctatcaattccttagaaagtaaaataaatgaatagatcaaatgttgtgttcatgtttggggaaaatataatttgcagaaacctatgaagtagagcaaagatgctttaaaaagataagtttttttgaactaaattttttttagttctaataatgcacataggatattagtacatcgtacacgtgctaggaaaaaacagcttcagtgtctttgtttaatgtgttgaaactcatctttttaaatcttgaaaaaccaattgtttacttgaaacttgaaagtagcatatttttctgttttttggttgtttgttcatttgtattagcacaatttaatgtaattcctggtttggaggcagcaagacctatgagcaagaactatttacttgaccctcgtttttttctcttgttcttgtgtggtctgaaatctaaaactagactttattatgatagatttcctataagccaatttctaataacaaatagatttattatttaatctgtaccttctatcttctcataattcgtggtcttacagccttccaaaataactccagttgggcacccatgagctaggatcaaactttctttatatactttatatattttacattatttctgatttttaaagcaaatgattgccattatgattacactcaacctaaatagttatgaacagtttcagaacaatgaaaaattacaatactatgtgatagtattgtaactatttttctattttagtcatatgtcgcttatatcctaccagaactcttaaatctataatattcgatatattctacaaactgctttattgtagaagccatatttatgtttattttataatgttttctagtgtcaaactgtactgtggagaaaagaaatgttagatctgtgttctgtctgcattttttttgagtacatacccttcaccctcaaaaaaaaaaaaaaaaaaa

SEQ ID NO: 104 - DNA, 1321 bp, Homo sapiens
ggcacgagcccaggagtgcagtggtatgatcatagttcaccgtagcctcaaactcgtgggctcaagtgatcctccagccttaacctcccgaatagcctggcttataggtgcacgccacacacctgactgctcagtatgtaaatttttactatgcctaaggttgaccaccttttaatatgtttaggagccatttgtatttccttttgtttcccatattgttttgttcctatccatttttctactatatcgttgatatgttgtttatttgttagggatatgaaccctttgacagtaatgagttgcaaatattttctttccaatttgtcatctgtcttttgcttatgatggctttgtcatgagttttaaaaaatttttatgtagtctgaattaccagtttttttagtggtttctggattttgagtcataattagaatgtatttctcaatccagagcaatagagtaattcacctaaattctacatctaaattttgaacctctgaagcatattctggcataagatataagttatggatctaacctaattttttccgcaggtgattaacccagttgttccaatattatttattgaactgtttgttttttcctgacgagtttgagaggctacattgatcttatcttagaatccgtcatatgtatttagctgtgtatctgcttctgtttctctgtatctgtttctatttcattgctctatttagtcatgcactagtaccacattgttttaattacccaggctttagttttaatctagtgcattggtcctccctcattcctcccctgcccaccttttttttttttaacagtttttctaactgttcttatttttccatatgagctttaaaaaattcttaacatatagagcatactaaaactgtccaactcaagttctctcccaagggttgcacttttaaccacttattttgtcactgttcttttgatactttacctgataaagatacactttttactacttttaaattattacagtgttctatttggcagtgcccaaacaggtgatggcagatagaggcaggatgcaatgcctgtgtggaaagaatgtcatctcagtgcttctattttaagatagtctctaggaatgatttaaggactgttctcatgtaaaatccctatttctttttttattccattacgaattatttgcccaaaagttggatatctgtcaaagattcataagacaagagggagagacccttaaataagtactaaacttgtaaaatcaatatgtggataaaagtgcaagtacaagaagttactttggaaaaaaaaaaaaaaaaaaaaaaaa

SEQ ID NO: 105 - DNA, 944 bp, Homo sapiens
  misc_feature (889)..(889): n equals a,t,g, or c
  misc_feature (896)..(896): n equals a,t,g, or c
gaaaaagtacaagcccctctcaaatggttcaagtttcaaatattagacccacccatggcaaagacagattttagtataatactcctaaaactacactgtcttttttttttttctgtcataagtgtgcattgtgctcagtcatttatttcagtgacccaaacagagcccagtccagctgtttgtattttccctgcagtgggaagtggactagggccatgtgactaagaaagccagcctgggggctgtcttttcacctacagatgttttaatgtgcttaacattatccaatactagcaaccgagatagtctaaataccacagcaggatctgattagctttttcagatcactgcctttatttgctgtttgcaaaaaagcttaatccagtgctagagatcaggcttcctgctgagccctggggtagtttctctcattctttgtgttcacagtggcaggcgttagtgagcagattcctcctcctcctaaattaaagctgtaaagtagtaactgtagtagcaagggataaagagaaggaagaaaacccaagggaaaaaagaagactgtctattcataccaagtagtttccttgatatacacaaaagaaagagtttctaatatgaattcataaatactgacctcagtgtctcttctactcagtgcacagctattaagttttattaggtttcagttgtaactactttgtgtggatatatgttacgtttttcatatttatcctactcaatcaatctcagttttaccagaagaattacatttattagccataacagtggcccttctcttattcttttcagggctgatatcttttttattcatgagatttcaaaaagaactatcaccaccactaacaaaaaaaaaaaaaaaaaaaaaagnacggccnctctagaggatccctcgaggggcccaagcttacgcgtgcatgggacgt

SEQ ID NO: 106 - DNA, 1172 bp, Homo sapiens
  misc_feature (904)..(904): n equals a,t,g, or c
ggcgggccgaggactccagcgtgcccaggtctggcatcctgcacttgctgccctctgacacctgggaagatggccggcccgtggaccttcacccttctctgtggtttgctggcagccaccttgatccaagccaccctcagtcccactgcagttctcatcctcggcccaaaagtcatcaaagaaaagctgacacaggagctgaaggaccacaacgccaccagcatcctgcagcagctgccgctgctcagtgccatgcgggaaaagccagccggagcatccctgtgctgggcagcctggtgaacaccgtcctgaagcacrtcatctggctgaaggtcatcacagytaacatcctccagctgcaggtgaagccctcggccaatgamcaggagctgctagtcaagatccccctggacatggtggctggattcaacacgcccctggtcaagaccatcgtggagttccacatgacgactgaggcccaagccaccatccgcatggacaccagtgcaagtggccccacccgcctggtcctcagtgactgtgccaccagccatgggagcctgcgcatccaactgctgcataagctctccttcctggtgaacgccttagctaagcaggtcatgaacctcctagtgccatccatgccaaggtggcccaactgatcgtgctggaagtgtttccctccagtgaagccctccgccctttgttcaccctgggcatcgaagccagctcggaagctcagttttacaccaaaggtgaccaacttatactcaacttgaataacatcagctctgatcggatccagctgatgaactctgggattggctggttccaacctgatgttctgaaaaacatcatcactgaratcatccactccatcctgctgccgaaccagaatggcaanttaagactggggtcccagtgtcattggtgaaggccttgggattcgaggcagctgagtcctcactgaccaaggatgcccttgtgcttactccagcctccttgtggaaacccasctctcctgtctcccagtgaagacttggatggcagccatcagggaargctgggtcccagctgggartatgggtgtgagctctatagaccatccctctctgcaatcaataaacacttgcctgtgaaaaaaaaaaaaaaaaaaaaaaaaaaaaaaaaaa

SEQ ID NO: 107 - DNA, 427 bp, Homo sapiens
ccacgcgtccggtgggctcactgttgggctccagcctagtggcactgctgtccttgcccgggggctggctgcactgccccaaggactttgggaacatcaacaattgccggatggacctctacttcttcctgctggctggcattcaggccgtcacggctctcctatttgtctggatcgctggacgctatgagagggcgtcccagggcccagcctcccacagccgtttcagcagggacaggggctgaacaggccctattccagcccccttgcttcactctaccggacagacggcagcagtcccagctctggtttccttctcggtttattctgttagaatgaaatggttcccataaataaggggcatgagcccttcctcaaaaaaaaaaaaaaaaaaaaaaaaaaaaaaaaaaaaaaaaaaaaaaaaaaa

SEQ ID NO: 108 - DNA, 1708 bp, Homo sapiens
  misc_feature (85)..(85): n equals a,t,g, or c
  misc_feature (254)..(254): n equals a,t,g, or c
  misc_feature (256)..(256): n equals a,t,g, or c
  misc_feature (423)..(424): n equals a,t,g, or c
ctcgtgcgaattcggcagagctctgggccaatatggcagcgcccagcaacaagacagagctggcctggagtccgcggctggccgngtgagtaggtgattgtctgacaagcagaggcatgagctgggtccaggccaccctactggcccgaggcctctgtagggcctggggaggcacctgcggggccgccctcacaggaacctccatctctcaggtccctcgccggctccctcggggcctccactgcagcgcactncncatagctctgaacagtccctggttcccagcccaccggaaccccggcagaggcccaccaaggctctggtgccctttgaggacctgtttgggcaggcgcctggtggggaacgggacaaggcgagcttcctgcagacggtgcagaaatttgcggasacagcgtgcgtaannggggccacattgacttcatctacctggccctgcgcaagatgcgggagtatggtgtcgagcgggacctggctgtgtacaaccagctgctcaacatcttccccaaggaggtcttccggcctcgcaacatcatccagcgcatcttcgtccactaccctcggcagcaggagtgtgggattgctgtcctggagcagatggagaaccacggtgtgatgcccaacaaggagacggagttcctgctgattcagatctttggacgcaaaagctaccccatgctcaagttggtgcgcctgaagctgtggttccctcgattcatgaacgtcaaccccttcccagtgccccgggacctgccccaggaccctgtggagctggccatgtttggcctgcggcacatggagcctgaccttagtgccagggtcaccatctaccaggttcctttgcccaaagactcaacaggtgcagcagatcccccccagccccacatcgtaggaatccagagtcccgatcagcaggccgccctggcccgccacaatccagcccggcctgtctttgttgagggccccttctccctgtggctccgcaacaagtgtgtgtattaccacatcctcagagctgacttgctgcccccggaggagagggaagtggaagagacgccggaggagtggaacctctactacccgatgcagctggacctggagtatgtgaggagtggctgggacaactacgagtttgacatcaatgaagtggaggaaggccctgtcttcgccatgtgcatggcgggtgctcatgaccaggcgacgatggctaagtggatccagggcctgcaggagaccaacccaaccctggcccagatccccgtggtcttccgcctcgccgggtccacccgggagctccagacatcctctgcagggctggaggagccgcccctgcccgaggaccaccaggaagaagacgacaacctgcagcgacagcagcagggccagagctagtctgagccggcgcgagggcacrggctgtggcccgaggaggcggtggactgaaggcatgagatgccctttgagtgtacagcaaatcaatgttttcctgcttggggctctcttccctcatctctagcagtatggcatcccctccccaggatctcgggctgccagcgatgggcaggcgagacccctccagaatctgcaggcgcctctggttctccgaattcaaataaaaaggggcgggagcgctgttggttgtgcgcaaaaaaaaaaaaaaaaaaaaaaaaaaaaaaaaaagggcggccgc

SEQ ID NO: 109 - DNA, 1487 bp, Homo sapiens
  misc_feature (78)..(78): n equals a,t,g, or c
  misc_feature (948)..(948): n equals a,t,g, or c
ccgctgctgataactatggcatcccccgggcctgcaggaattcggcacggagctacggcgccgcctggctcctgctgncacctgcaggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggasgagccaggcgagcacacccccctgttggcccctgccacggcccagcccctgctgctctggaagcactggctccgggagcsggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagckttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctgatgagacctgcacgcantggctcacagcagcacgatttgtgacagcccgaggcggagaacaccgaacacccagtgaaggtgaggggatcagcacggcgcggccacccacgcacccacgcgctggaatgagactcagccacaaggaggtgcgaagctctgacccaggccacagtgcggatgcaccttgaggatgtcacgctcagtgagagacaccagacacagaagggtacgctgtgatcccacttctatgaaatgtccaggacagaccaatccacagaatcagggagaggattcgtgggtgccgggactggggagggggacctgggggtgactaggtgacataatggggacagggctgccttctgggtgatgagaatgttctggaatcagatgggatggctgcacggcgtggtgaaggtactgaacgccacctcactgtaagacggtagattttgtattttaccacaataaacaaaacaaaacaaaaccaaaaaaaaaaaaaaaaaaaaaaaaaaaaggaattcgatatcaagcttatcgataccgtcgacctcga

SEQ ID NO: 110 - DNA, 1525 bp, Homo sapiens
  misc_feature (78)..(78): n equals a,t,g, or c
ccgctgctgataactatggcatcccccgggcctgcaggaattcggcacggagctacggcgccgcctggctcctgctgncacctgcaggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggasgagccaggcgagcacacccccctgttggcccctgccacggcccagcccctgctgctctggaagcactggctccgggagcsggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggactktcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctgggaccgtgatgcccggccctgactcctgacagcctcctgcacctgtgcaagggaactgtggggacgcacgaggatgccccccarggccttggggaaaagcccccactgcccctcactcttctctggacccccaccctccatcctcacccagctcccgggggtggggtcgggtgagggcagcagggatgcccgccagggacttgcaaggaccccctgggttttgagggtgtcccattctcaactctaatccatcccagccctctggaggatttggggtgcccctctcggcagggaacaggaagtaggaatcccagaagggtctgggggaaccctaaccctgagctcagtccagttcacccctcacctccagcctgggggtctccagacactgccagggccccctcaggacggctggagcctggaggagacagccacggggtggtgggctgggcctggaccccaccgtggtgggcagcagggctgcccggcaggcttggtggactctgctggcagcaaataaagagatgacggcaaaaaaaaaaaaaaaaaaaaaaaaaaaaaaaaaaaaaaaaaaaaaaaaaaacccaccgtccgc

SEQ ID NO: 111 - DNA, 552 bp, Homo sapiens
ccacgcgtccggtcagaatgccttggaaaagagctgtagttctcctaatgttatggtttatagggcaggccatgtggctggctcctgcctatgttctagagtttcaaggaaagaacacctttctgtttatttggttagctggtttgttctttcttcttatcaattgttccatcctgattcaaattatttcccattacaaagaagaacccctgacagagagaatcaaatatgactagtgtatgttccacaccctctgctactgtgttacattctgattgtcttgtatggaccagaagagagctttgggacattttttctgaacattctaagcattctagtgaaagttcccatgttccaacagaacttaaaagcaatgtttgccttatatataaaagggacacaataattgaggtccaccttctaggaaatcctaggactcgtttatttgggacatggtgggaataaaggtcacatattggaaaaaaaaaaaaaaaaaaaaaaaaaaaaaaaaaaaaaaaaaaaaaaaaaaaaaaaaaaaaaaaaaaaaaaaaa

SEQ ID NO: 112 - DNA, 925 bp, Homo sapiens
  misc_feature (444)..(444): n equals a,t,g, or c
ctgcaggaattcggcacgagcggaaccggggccggctgctgtgcatgctggcgctgaccttcatgttcatggtgctggaggtggtggtgagccgggtgacctcgtcgctggcgatgctctccgactccttccacatgctgtcggacgtgctggcgctggtggtggcgctggtggccgagcgcttcgcccggcggacccacgccacccagaagaacacgttcggctggatccgagccgaggtaatgggggctctggtgaacgccatcttcctgactggcctctgtttcgccatcctgctggaggccatcgagcgcttcatcgagccgcacgagatgcagcagccgctggtggtccttggggtcggcgtggccgggctgctggtcaacgtgctggggctctgcctcttccaccatcacagcggcttcagccaggactccggccacngccactcgcacgggggtcacggccacggccacggcctccccaaggggcctcgcgttaagagcacccgccccgggagcagcgacatcaacgtggccccgggcgagcagggtcccgaccaggaggagaccaacaccctggtggccaataccagcaactccaacgggctgaaattggaccccgcagacccagaaaaccccagaagtggtgatacagtggaagtacaagtgaatggaaatcttgtcagagaacctgaccatatggaactggaagaagatagggctggacaacttaacatgcgtggagtttttctgcatgtccttggagatgccttgggttcagtgattgtagtagtaaatgccttagtcttttacttttcttggaaaggttgttctgaaggggatttttgtgtgaatccatgtttccctgacccctgcaaagcatttgtagaaatattaatagtactcatgcatcagtttatgag

SEQ ID NO: 113 - DNA, 1774 bp, Homo sapiens
ggcacgaggtccccgacgcgccccgcccaacccctacgatgaagagggcgtccgctggagggagccggctgctggcatgggtgctgtggctgcaggcctggcaggtggcagccccatgcccaggtgcctgcgtatgctacaatgagcccaaggtgacgacaagctgcccccagcagggcctgcaggctgtgcccgtgggcatccctgctgccagccagcgcatcttcctgcacggcaaccgcatctcgcatgtgccagctgccagcttccgtgcctgccgcaacctcaccatcctgtggctgcactcgaatgtgctggcccgaattgatgcggctgccttcactggcctggccctcctggagcagctggacctcagcgataatgcacagctccggtctgtggaccctgccacattccacggcctgggccgcctacacacgctgcacctggaccgctgcggcctgcaggagctgggcccggggctgttccgcggcctggctgccctgcagtacctctacctgcaggacaacgcgctgcaggcactgcctgatgacaccttccgcgacctgggcaacctcacacacctcttcctgcacggcaaccgcatctccagcgtgcccgagcgcgccttccgtgggctgcacagcctcgaccgtctcctactgcaccagaaccgcgtggcccatgtgcacccgcatgccttccgtgaccttggccgcctcatgacactctatctgtttgccaacaatctatcagcgctgcccactgaggccctggcccccctgcgtgccctgcagtacctgaggctcaacgacaacccctgggtgtgtgactgccgggcacgcccactctgggcctggctgcagaagttccgcggctcctcctccgaggtgccctgcagcctcccgcaacgcctggctggccgtgacctcaaacgcctagctgccaatgacctgcagggctgcgctgtggccaccggcccttaccatcccatctggaccggcagggccaccgatgaggagccgctggggcttcccaagtgctgccagccagatgccgctgacaaggcctcagtactggagcctggaagaccagcttcggcaggcaatgcgctgaagggacgcgtgccgcccggtgacagcccgccgggaaacggtttttggcccaagggaacattaatgacttacccttttgggactctgcctggtcttgctgagcccccggttagtgcattgcggcccgagggctccgagccaccaggttccccacttcgggcccttcgccggaggccaggctgttcacgcaagaaccgcacccgcagccatgccgtctgggccaggcaggcagcgggggtggcgggactggtgactcagaaggctcaggtgccctacccagcctcacctgcagcctcacccccctgggcctggcgctggtgctgtggacagtgcttgggccctgctgacccccagcggacacaagagcgtgctcagcagccaggtgtgtgtacatacggggtctctctccacgccgccaagccagccgggcggccgacccgtggggcaggccaggccaggtcctccctgatggacgcctgccgcccgccacccccatctccaccccatcatgtttacagggttcggcggcagcgtttgttccagaacgccgcctcccacccagatcgcggtatatagagatatgcattttattttacttgtgtaaaaatatcggacgacgtggaataaagagctcttttcttaaaaaaaaaaaaaaaaaa

SEQ ID NO: 114 - DNA, 1777 bp, Homo sapiens
ggcacgaggtccccgacgcgccccgcccaacccctacgatgaagagggcgtccgctggagggagccggctgctggcatgggtgctgtggctgcaggcctggcaggtggcagccccatgcccaggtgcctgcgtatgctacaatgagcccaaggtgacgacaagctgcccccagcagggcctgcaggctgtgcccgtgggcatccctgctgccagccagcgcatcttcctgcacggcaaccgcatctcgcatgtgccagctgccagcttccgtgcctgccgcaacctcaccatcctgtggctgcactcgaatgtgctggcccgaattgatgcggctgccttcactggcctggccctcctggagcagctggacctcagcgataatgcacagctccggtctgtggaccctgccacattccacggcctgggccgcctacacacggtgcacctggaccgctgcggcctgcaggagctgggcccggggctgttccgcggcctggctgccctgcagtacctctacctgcaggacaacgcgctgcaggcactgcctgatgacaccttccgcgacctgggcaacctcacacacctcttcctgcacggcaaccgcatctccagcgtgcccgagcgcgccttccgtgggctgcacagcctcgaccgtctcctactgcaccagaaccgcgtggcccatgtgcacccgcatgccttccgtgaccttggccgcctcatgacactctatctgtttgccaacaatctatcagcgctgcccactgaggccctggcccccctgcgtgccctgcaatacctgaggctcaacgacaacccctgggtgtgtgactgccgggcacgcccactctgggcctggctgcagaagttccgcggctcctcctccgaggtgccctgcagcctcccgcaacgcctggctggccgtgacctcaaacgcctagctgccaatgacctgcagggctgcgctgtggccaccggcccttaccatcccatctggaccggcagggccaccgatgaggagccgctggggcttcccaagtgctgccagccagatgccgctgacaaggcctcagtactggagcctggaagaccagcttcggcaggcaatgcgctgaagggaccgcgtgccggccggggacaggcccggcgggaaacggtttttggcccaagggaacattaatgacttacccttttgggactctgcctggttttggtgagcccccggttacttgcagtgcggcccgagggatccgagccaccaggttccccacttcgggcccttcgccggaggccaggctgttcacgcaagaaccgcacccgcagccatgccgtctgggccaggcaggcagcgggggtggcgggactggtgactcagaaggctcaggtgccctacccagcctcacctgcagcctcacccccctgggcctggcgctggtgctgtggacagtgcttgggccctgctgacccccagcggacacaagagcgtgctcagcagccaggtgtgtgtacatacggggtctctctccacgccgccaagccagccgggcggccgacccgtggggcaggccaggccaggtcctccctgatggacgcctgccgcccgccacccccatctccaccccatcatgtttacagggttcggcggcagcgtttgttccagaacgccgcctcccacccagatcgcggtatatagagatatgcattttattttacttgtgtaaaaatatcggacgacgtggaataaagagctcttttcttaaaaaaaaaaaaaaaaaa

SEQ ID NO: 115 - DNA, 1340 bp, Homo sapiens
ggcacgagaaagaaaggcgagagaaaaatcaaggcaccaaatttagattggaggtctcagaggagcagtgttttccctccttcgtaacagttgaacaacttccagatgtagctagctgcaccccctgtaaagatgcaggctctttacaatgaagacacatcttctgatgttccttctctcctgtatggccagatgcacaggaatagtgcccaaaagacctcagcctgctttccctttaaggggaaggagaagaaaaaactcctttttatttttactttctttcagcattgaatttttgttgtgtgtatggtgacttctgtttttgggaaacgggaagaagccagcagcatgctgaattgtcctgacaggctccgctgggctcttgccgaggttagcagtgctttttttgtatttaaaccatctcccgggcagtgtaaaaagtttgcaggtgcggacattctgtctgactggtctcggcagtgctctataaccctgttgtgtttcttgataaaacacagccccaccctttaataaagcaaagattgctatgaaaccagagagtctattcattactgtggagtaactagagcagtctgtagtgactagacatacggcaattaggaagtcatggagttgggatttttgtcttaattttggctgctcaaagtgccccctgtaggatattcttttttcgggaattgtttccaaacttgcctgtctttatctatggtgaaactcaagccgctttttaaggcaagcctgcaaacccaagtatcaacatgggctcctgaaggcacagggagcagattcacagttctgaccagtgttagggtccccacgagggccacccatttgaactcaaggttggcagactctggccccagcacttgccgtggtttcaggatggccagcggtgacacagggctatggaaccctgggtcttcatctcttcccatatcctttgtttcaccttctttttgccatattttattgtgcttcagatagaaattttatttataagataaaaagtagctctgaggctgggcacggtggctcatgcctgtggtcccagcactttgggaggccgaggtgggtggttcacgagctcagcagatcaagaccatcctggccaatatggtgaaaccctgtctctgctaaaaatacaaaaattggctgggcgtggtggcgggtgcctgtagtcccagctactcgggaggctgaggcgggagaatcgattggacccaggaggcggaggttgcagtgagcctagatggcaccactgcgctccagcctgggtgacagagggagactgcctcaaaaaaaaaaaaaaaaaaaaaaaa

SEQ ID NO: 116 - DNA, 813 bp, Homo sapiens
  misc_feature (338)..(338): n equals a,t,g, or c
  misc_feature (384)..(384): n equals a,t,g, or c
  misc_feature (389)..(389): n equals a,t,g, or c
  misc_feature (799)..(799): n equals a,t,g, or c
ctgcaggaattcggcacgagaaagaaaggcgagagaaaaatcaaggcaccaaatttagattggaggtctcagaggagcagtgttttccctccttcgtaacagttgaacaacttccagatgtagctagctgcaccccctgtaaagatgcaggctctttacaatgaagacacatcttctgatgttccttctctcctgtatggccagatgcacaggaatagtgcccaaaagacctcagcctgctttccctttaagggggaaggagaagaaaaaactcctttttatttttactttctttcagcattgaatttttgttgtgtgtatggtgacttctgtttttngggaaacggaagaagccagcagcatgctgaattgtcctgacaggcntccgntggctcttgccgaggttagcagtgctttttttgwatttaaaccatctcccgggcagtgtaaaaagtttgcaggtgcggacattctgtctgactggtctcggcagtgctctataaccctgttgtgtttcttgataaaacacagccccaccctttaataaagcaaagattgctatgaaaccagagagtctattcattactgtggagtaactagagcagtctgtagtgactagacatacggcaattaggaagtcatggagttgggatttttgtcttaattttggctgctcaaagtgccccctgtaggatattcttttttcgggaattgtttccaaacttgcctgtctttatctatggtgaaactcaagccgctttttaaggcaagcctgcaaacccaagtatcaacatggggncctgaagggacagg

SEQ ID NO: 117 - DNA, 1681 bp, Homo sapiens
cgatggccccgcggccgctctagaaagtcccgttttttttttttttttttttttttttttttttagagtacgttctgcattttatttytgcaggcaacactttgctcaccagcaagaacacagcccraggaagggacccaataacctttcaaaacscaaactgctkcctgcggtgagggcccagggtcctccacggagaggacaggcatcttcctttcccaccaggaaggagtcagcccggagcctctgctatgtgcaaggcggtgtgcaagcaccggctgcggctctttgctgtctcttctttctctttggggctgggctgggtgtgcgttctggtgctgatgctttggcctgtgaggctgagcttggcayctcgacccgttcaattacagcaacgaagaagccactgctragygtggtctcaggggargcccggaggcagtgctcggcacccgggaacgtgctcaggcctcggtggggccaggcaggcagggcgggagctagcctgaaggcgcccgggttctgctgcagcgcatctcgcaccacgtcttcattctcctcctggcagagggagcacgtggagtagacgagccgctgcagggaagggaaagtgagcgcgtggcacagggctcgctgctggaaccctgccagggcatgcagacgcaccgggctaggtgtscctgccccgggmtcctccagctgtctgctcggcatacccgagccactgcaggaaggatccagcaggayrtagtggacctcaygrtagcgyggatcyragggggagaccgccaggaagtcctcctcagccagytcacagcargagacgccagcccrggccagcagcgtggccatggatgccagccgcttggcatccaggtcaaaggcaaagatcttcccttggttcttcagaagagcagccaagtgactggtcttattgcctggggcggcacaggcatcgatgacatgggagcctggcggggggtccagcagcatggctgggagacagctggccctgtcctgcagaatgaggtgtccggcccggtacagtgggtgttcatgcagatctgtctgggcgggaaacaccagcagctccggcatcaaggggtccaggagaaaatgcttccccttgagggctcgtaagtcatcgaggctggaagcccgaccctgataggagaaaccttgtctcttgaaataatcaactacatcatcggagcaggtcttgagagtgttcacacgcacaaatcgaggcagctgggaggctggaccaggcctggatcccacttccaacaggtcctcattccggctcacaccccgatgaaccttgagccgagccaactcagccttgagcctcgcctggtgccggcccaacagagccttccatcggcccccaccccctcgaaagccctttcccaacaacaactcatacactagcaccttggccaggtgcggccgcagcttcttctccgcacggaggaggccggcgctggcgatcacagcatccagcacggcggagtagcgctgcgtttcgcacaccagcgcgtacagctgcttcacgttctggaagttgctggagtacaccaaccccttgatagagcctggcggctctccacgccggccaacacgcctgcagctgcagcatacagccccatgttccgtcgcgctttacggctttgtggcaaaa

SEQ ID NO: 118 - DNA, 2052 bp, Homo sapiens
  misc_feature (2045)..(2045): n equals a,t,g, or c
tttgcttttcaaatgctcccaaggtctcagatgaagcggtgaaaaaagattcagagttggataagcacttggaatcacgggttgaagagattatggagaagtctggcgaggaaggaatgcctgatcttgcccatgtcatgcgcatcttgtctgcagaaaatatcccaaatttgcctcctgggggaggtcttgctggcaascgtaatgttattgaagctgtttatagtagactgaatccacatagagaaagtgatgggggtgctggagatctagaagacccatggtagccttaaaaaccttctaaaatgcttttrattctgaaaattgggggaaaaaacttttaatcacaattttcttcaatacaaggggaaaatattcttgcggattcccaacgttttgtgatatgagcagaaaatcattagcatttcccatcatttgttcatatttgtgttttctgacagttgccacttgtagcattgcctgtactacagtattttttgccaacctcaggcatactcgttacatctgtattgaactttcggccctagaaaccagtggagttatttcaccacaaatcaacaatgtgcctgaggtgcatgggaaatatagttagctatactctgaaaatacattatgttttttttctttaaacaaaacacacaacatgtaagcatgtaagagtaaagaattgtatgatatgttccttttttcagttcaccaagttggaagccttttgcagctctgtggcttggaatttcatttgagcaatttctataggatatgtatttattattgattgttatttaawttttttcccaattttacctgtattaccaaactgggttctccaataatgtccaaattgtaatgttgccttgcttcaagataaagtgtatttgggaataatattataaacccttacaaattttatgcatgtatctactgcatccttcaactctcactagaaaatcttttgaaaccaaatggattaatttatggctatttataatttgctttgacatctcactgttggaaattttttaaagatgagatttgcctttataatgtaaattgtgatttttgttttacatgtgggtttctatagttttaattttttcagcttttaagatacgagttttgtgtaatttggtatttttaatcatttatgttattttaaaagctcagaatatcacattgaaattactataaatacatttaaaattatctattttagatctaaggaaatactacagagatattttcatgggttcagtaacttttcattttataacattgggcacggtacagagtgattgtcacataaggtacttgaagatttattagtttaattctatttttacagtaaccttgaattcttctgagttttgcatgtattaaattcaattaatgctgaacatgaagagtaaagtatttatctgaaagaagtttctgggttaggagaagtaatgaatgtatccatttgtacatggtttacatgttgtggatgctttgtaaacattttcctgtatgtttaaattgtgtttcagcaggatgtaattgcccttgtgtgtagttaaaatgagtcatcatctggtcctttgtgaaatggaattcatggtattttctgtaacgttttcctgaagctgtttctggagagccacacatttaaatacagacagctttcctgatcatttgatttattgtgcacctgatttttggtctaaaaggaattattgccacaatatattttatttattctttagattttagccttgtaagttaaagtgctttacatgatgatgtgaaaagctgtttgtccctttactgggtttggggggttgttaaaagatagggaatgaagaatgcaaaatggtttatcgttcaaactgtccactctgatccaaccctgtactgatagtacttcccagtatgatattgtgatgtttcatacaatgcagtgaacataaccaacttgttacctaaataaagaattgataaaaacagtgtgacatattaaaaaaaaggggggcccggtacccaattcnccctata

SEQ ID NO: 119 - DNA, 539 bp, Homo sapiens
  misc_feature (528)..(529): n equals a,t,g, or c
  misc_feature (531)..(532): n equals a,t,g, or c
  misc_feature (537)..(537): n equals a,t,g, or c
gagatacattccatgaatacctagtttattgagagtttttagcatgaaggactgtcgaattttgtcaaaggctttttctgcatctattgagataatcatgtggtttttgtctttggttctgtttatgtgatggactatgtttattgatttgcatatgttgaaccagccttgcatctcagggatgaagccaactcgatcgttgtggataagctttttgatgtgctgctggatttggtttgccaatattttattgaggatttttgcatcagtgttcttcagggatattggtctaaaattctcttttttttgttgtgtctctgccaggctttggtatcaggatgatgctggcctcataaatgagttagggaggattccctctttctattgatcagaatagtttcagaaggaatggtaccagctcttctttgtacctctggtagaatttgggtgkgaatctatcttgkcctggaatatttttggggttggaactcaaaaaaaaaaaaaaaaaaatcaaaaaaaaaaaaaaannannaaaanaa

SEQ ID NO: 120 - DNA, 882 bp, Homo sapiens
  misc_feature (117)..(117): n equals a,t,g, or c
gaattcggcacgagcagacctgggctcgagaccataactgtttggctttaacagtacgtgggcggccggaatccgggagtccggtgacccgggctgtggtctagcataaaggcgganccagaagaaggggcggggtatgggagaagcctccccacctgcccccgcaaggcggcatctgctggtcctgctgctgctcctctctaccctggtgatcccctccgctgcagctcctatccatgatgctgacgcccaagagagctccttgggtctcacaggcctccagagcctactccaaggcttcagccgacttttcctgaaagtaacctgcttcggggcatagacagcttattctctgcccccatggacttccggggcctccctgggaactaccacaaagaggagaaccaggagcaccagctggggaacaacaccctctccagccacytccagatcgacaagatgaccgacaacaagacaggagaggtgctgatctccgagaatgtggtggcatccattcaaccagcggaggggagcttcgagggtgatttgaaggtacccaggatggaggagaaggaggccctggtacccatccagaaggccacggacagcttccacacagaactccatccccgggtggccttctggatcattaagctgccacggcggaggtcccaccaggatgccctggagggcggccactggctcagcgagaagcgacaccgcctgcaggccatccgggatggactccgcaaggggacccacaaggacgtcctagaagaggggaccgagagctcctcccactccaggctgtccccccgaaagacccacttactgtacatcctcaggccctctcggcagctgtaggggtggggaccggggagc

SEQ ID NO: 121 - DNA, 1193 bp, Homo sapiens
acactatataagttacgcctgcaggttaccggtccggtaattcccgggtcgtacccacgcgtccggtaatgtcaaaggaaaagtaattctgtcaatgctggttgtctcaactgtgatcattgtgttttgggaatttatcaacagcacagaaggctctttcttgtggatatatcactcaaaaaacccagaagttgatgacagcagtgctcagaagggctggtggtttctgagctggtttaacaatgggatccacaattatcaacaaggggaagaagacatagacaaagaaaaaggaagagaggagaccaaaggaaggaaaatgacacaacagagcttcggctatgggactggtttaatccaaacttgaaggaatccgaataactaaactggactctggttttctgactcagtccttctagaagacctggactgagagatcatgcggttaaggagtgtgtaacaggcggaccacctgttgggactgsgagattctcaaggggaaggactgggtctcatttctcccatctcagcgcttagcaggatgacctggtatagagcagggaactgggaaatgtgggtcaggggatcagacactccagttgggtcttttatataaattaaatggcaaaaggctccatacccttctccttctttcctaccctccactttatctgcaaaatgggaatgatgataacacccacttcatagaatggtcatgaagatcaaatgagagaataaaagtcaagcacttagcctctggtgcacaataagtattaaataagtatacctattcctccttttccttttttaaaaataatattaccaaatgtccagcttatacacatttacaagacttagctagtgggctatgttagagctactaaaagatctttgacaagctaaaactaagatgcaatgaatgaggtgtaacgaacaagagagttttaagttcagaaatggttacagaagtataagacagctgtgtgggtgttttttggtttttggtttctggtttacaatctcgtcattcaacaaagatgggagttttatagaactaaaagcmccatgtaagctactaaaaacaacaacaaaaaaggctcatcatttctcagtctgaattgacaaaaatgccaatgcaaataaaaatgattactttttattttaaaaaaaaaaaaaaaaaaaaaaaactcgta

SEQ ID NO: 122 - DNA, 1338 bp, Homo sapiens
  misc_feature (519)..(519): n equals a,t,g, or c
ggcacgagggtgaggcccaggtagcgtttgcaatccagccccaccgtcacctcttttcttggacttctagttttcctcacccctattgccttcatccttttacctccgatcctgtggagggaatgagctggagccttgtggcacaatttgtgaggggctctttatctccatggcattcaaactcctcattctgctcatagggacctgggcactttttttccgcaagcggagagctgacatgccacgggtgtttgtgtttcgtgcccttttgttggtcctcatctttctcttttgtggtttccctattggcttttttacggggtccgcattttggactctcgggaaccggaattaccaagggattgtgcaatatgcagtctccccttgtggaatgccctcctccttccatccattactggccatccgtccctgctggagctcagggagcttgcagcccaatgttccacgctgcaggttggtcccgctcccaaccgaatggggaaatccccgcttccagcntgggacacctgagtatccagcgagcagcattggtggtcctagaaaattactacaaagatttcaccatctataacccaaacctcctaacagcctccaaattccgagcagccaagcatatggccgggctgaaagtctacaatgtagatggccccagtaacaatgccactggccagtcccgggccatgattgctgcagctgctcggcgcagggactcaagccacaacgagttgtattatgaagaggccgaacatgaacggcgagtaaagaagcggaaagcaaggctggtggttgcagtggaagaggccttcatccacattcagcgtctccaggctgaggagcagcagaaagccccaggggaggtgatggaccctagggaggccgcccaggccattttcccctccatggccagggctctccagaagtacctgcgcatcacccggcagcagaactaccacagcatggagagcatcctgcaagcacctggccttctgcatcaccaacggcatgacccccaaggccttcctagaacggtacctcagtgcgggccccaccctgcaatatgacaaggaccgctggctctctacacagtggaggcttgtcagtgatgaggctttgactaatggattacgggatggaattgtgttcgtccttaagtgcttggacttcagcctcgtagtcaatgtgaagaaaattccattcatcatactctctgaagagttcatagaccccaaatctcacaaatttgtccttcgcttacagtctgagacatccgtttaaaagttctatatttgtggctttattaaaaaaaaaaaaaaaaaa

SEQ ID NO: 123 - DNA, 1183 bp, Homo sapiens
tgcaggaattcggcacgagctggctgcagggtctctggggagagaaggggcctcggcttcacaggatggggctgccagtgtcctgggcccctcctgccctctgggttctagggtgctgcgccctgctcctctcgctgtgggcgctgtgcacagcctgccgcagcccgaggacgctgtagcccccaggaagagggcgcggaggcagcgggcgaggctgcagggcagtgcgacggcggcggaagcgtccctactgaggcggacccacctctgcttccctcagcaagtcggacaccagactgcacgagctgcaccggggcccgcgcagcagcagggccctgcggcctgccagyatggatctcctgcgcccacactggctggaggtgtccagggacatcaccggaccgcaggcagccccctctgccttcccacaccaggagctgccccgggctctgccggcagctgcagccaccgcaggtgcgctggcctcgaggccacctattccaacgtggggctggcggcccttcccggggtcagcctggcggccagccctgtggtggccgagtatgcccgcgtccagaagcgcaaagggacccatcgcagtccccaagagccacagcaggggaagactgaggtgaccccggccgctcaggtggacgtcctgtactccagggtctgcaagcctaaaaggagggacccaggacccaccacagacccgctggaccccaagggccagggagcgattctggccctggcgggtgacctggcctaccagaccctcccgctcagggccctggatgtggacagcggccccctggaaaacgtgtatgagagcatccgggagctgggggaccctgctggcaggagcagcacgtgcggggctgggacgccccctgcttccagctgccccagcctagggaggggctggagacccctccctgcctccctgccctgaacactcaaggacctgtgctccttcctccagagtgaggcccgtcccccgccccgccccgcctcacagctgacagcgccagtcccaggtccccgggccgccagcccgtgaggtccgtgaggtcctggccgctctgacagccgcggcctccccgggctccagagaaggcccgcgtctaaataaagcgccagcgcaggatgaaagcgaaaaaaaaaaaaaaaaaagggcggccgc

SEQ ID NO: 124 - DNA, 615 bp, Homo sapiens
  misc_feature (18)..(18): n equals a,t,g, or c
  misc_feature (20)..(20): n equals a,t,g, or c
  misc_feature (584)..(584): n equals a,t,g, or c
cctgtatataaaattggncnctatggtcccgtacaatgaagaaatgcaaagatagttaagaaagactcggccttcaaggagcctaaatgtgtagaaaaggactaaggcaaaacaataacttttttgagctcttgccatgtgtgaagcactttatacacctgtaaggtaggtaacgttgttcttattaaacatgaagaaaatgagactttgtgagaagcaatacagtatagaagttaagaatatggactctaaagctagatttcagaggtttgaagtagctctgctacttactggctgtgtgactttgagcagattacttaacctgtctgtgcctatgtttacttttattgttgtaaaaagatatgcaacataaaatattccatttcaaccgtttttacgtgtatacttcactgacattagttgcattcactatgttgtgcaaacgtagggtcgctatgaagattaaatgagttaattcatataaagccctcagaagagtgtctggcacatggtgagtattggctgtactgtggtcgatgtcattgttagagagctttagtgatttgcttaagacagaaaggtanactggggtgcggtgggctcacgccctggtta

SEQ ID NO: 125 - DNA, 587 bp, Homo sapiens
cccacgcgtccgcctggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaatatgtgccctggctccatgcagtttatgcagcactgggagcgggtgtatttacattgttcctggcacttgacacccagttgctgatgggtaaccgacgccactcgctgagccctgaggagtatatttttggagccctcaacatttacctagacatcatctatatcttcaccttcttcctgcagctttttggcactaaccgagaatgaggagccctccctgccccaccgtcctccagagaatgcgcccctcctggttccctgtccctcccctgcgctcctgcgagaccagatataaaactagctgccaacccaaaaaaaaaaaaaaaa

SEQ ID NO: 126 - DNA, 1379 bp, Homo sapiens
gggcccagcagcagcggcacctggagaagcagcacctgcgaattcagcatctgcaaagccagtttggcctcctggaccacaagcacctagaccatgaggtggccaagcctgcccgaagaaagaggctgcccgagatggcccagccagttgacccggctcacaatgtcagccgcctgcaccggctgcccagggattgccaggagctgttccaggttggggagaggcagagtggactatttgaaatccagcctcaggggtctccgccatttttggtgaactgcaagatgacctcagatggaggctggacagtaattcagaggcgccacgatggctcagtggacttcaaccggccctgggaagcctacaaggcggggtttggggatccccacggcgagttctggctgggtctggagaaggtgcatagcatcatgggggaccgcaacagccgcctggccgtgcagctgcgggactgggatggcaacgccgagttgctgcagttctccgtgcacctgggtggcgaggacacggcctatagcctgcagctcactgcacccgtggccggccagctgggcgccaccaccgtcccacccagcggcctctccgtacccttctccacttgggaccaggatcacgacctccgcagggacaagaactgcgccaagagcctctctggaagctggtggtttggcacctgcagccattccaaccttcaacgggccagtacttccggctccatcccacagcagcggcagaagcttaagaagggaatcttctggaagacctgcgggccgctactacccgctgcaggccaccaccatgttgatccagcccatggcagcagaggcagcctcctagcgtcctggctgggcctggtcccaggcccacgaaagacggtgactcttggctctgcccgaggatgtggccgttccctgcctgggcaggggctccaaggaggggccatctggaaacttgtggacagagaagaagaccacgactggagaagccccctttctgagtgcaggggggctgcatgcgttgcctcctgagatcgaggctgcaggatatgctcagactctagaggcgtggaccaaggggcatggagcttcactccttgctggccagggagttggggactcagagggaccacttggggccagccagactggcctcaatggcggactcagtcacattgactgacggggaccagggcttgtgtgggtcgagagcgccctcatggtgctggtgctgttgtgtgtaggtcccctggggacacaagcaggcgccaatggtatctgggcggagctcacagagttcttggaataaaagcaacctcagaacacttaaaaaaaaaaaaaaaaaaaaaaaaaaaaaaaaaaaaa

SEQ ID NO: 127 - DNA, 583 bp, Homo sapiens
ccacgcgtccgggacatctgccggctggagcgggcagtgtgccgcgatgagccctctgccctggcccgggcccttacctggaggcaggcaagggcacaggctggagccatgctgctcttcgggctgtgctgggggccctacgtggccacactgctcctctcagtcctggcctatgagcagcgcccgccactggggcctgggacactgttgtccctcctctccctaggaagtgccagtgcagcggcagtgcccgtagccatggggctgggcgatcagcgctacacagccccctggagggcagccgcccaaaggtgcctgcaggggctgtggggaagagcctcccgggacagtcccggccccagcattgcctaccacccaagcagccaaagcagtgtcgacctggacttgaactaaaggaagggcctctgctgactcctaccagagcatccgtccagctcagccatccagcctgtctctactgggccccacttctctggatcagagaccctgcctctgtttgaccccgcactgactgaataaagctcctctggccgtttaaaaaaaaaaaaaaaaaaaaaaaaaa

SEQ ID NO: 128 - DNA, 1268 bp, Homo sapiens
  misc_feature (1184)..(1184): n equals a,t,g, or c
  misc_feature (1240)..(1240): n equals a,t,g, or c
agggttgatgggttatggtcaggagtcccagctgggcccaccacctcctcaggaaggcgggtgaggttggtgtgagactgacggtgcctcctcatgtccccttggagcgccccaccccacatctcccggcctcgggtccttgcctggcccagcatgagaggtgcttcataggaacggagggaggacatgtcgggacagctcgatgctcggcctgctgctgctctgcacccccagggcctggctcaccctctctggacctgtctgcttccaaggaagggaccctctgaggtcccacagaggccaccccagctgtgggtcgtgagcatctctgtcttgcagggacagcatcgtggccgagctggaccgagagatgagcagagcgtggacgtgaccaacaccaccttcctgctcatggccgcctccatctatctccacgaccagaacccggatgccgccctgcgtgcgctgcaccagggggacagcctggagtggtgagtggcctccctgctctgggccagcccagggaggcaagtgccccctgccacatctccaggctgcgcacggcctcgctggctgtcgtcatgggagcagagaaaggtggtgctgaaatgaggccctggcctgctgtccaggctccagctcccctgcccagtgtgggaggcactcccatctgcgcaccaggctgcggatccaaggacacggtgcccaggctgcaaccctctgttcccaagggcagagcagaaagcggctttgtctctgctcggtttctgtgtccccaccccccacgaagccttctgtgtctcggccctgggcccagtctctcaggcctccccgggccccccataccggccctcctccagggccctctggggttggggtgctgaagccctgcaaggttggtgcccccctccaccctaggatgtgactccgggccatgtccagggcactggtcacagaaagtgtgtcagttcttccccgtgagctgtccctgcagtgcctgccttccactgtgagttgcaagctgggcatttcatggtcgctgtggatctgctcccatcccacctccatccacagagggcttagaattgcagggcgagccaggcatggtgacatgcacctatgtttccagctacttgggaggcggaagtcaggagtatcccttgagtctgggaggtggaggctgncagtgagccgtgatggtgccactgcactccagcctgggtggcagagccagaccctnactcacacacaaaaaaaaaaaaaaaaaa

SEQ ID NO: 129 - DNA, 1311 bp, Homo sapiens
  misc_feature (1036)..(1036): n equals a,t,g, or c
  misc_feature (1112)..(1112): n equals a,t,g, or c
  misc_feature (1168)..(1168): n equals a,t,g, or c
  misc_feature (1223)..(1223): n equals a,t,g, or c
gaaaaaagaaagcaatatggaaaccgaactaaggagattttaaactgagatataagatgctttcaattattcccaatgacaggctatttatcaatttaatatttttaagcaacttcctcccatcagtgctctgggaaccagctgggcagatgtggtacacccatgtcagataccccagtggcaggctcctgtcactgtagcacttggtccctccatccctcccagccttcctagctccttgctcctggaaacctccccccatcaatctctgacatttcagaggaaatactgtttgtcacctcttaaggaatctgggaggacggcctgtgagatatggcgtcagttacagcctcttaaagagtcaatagcccctgcagaggccagaacactggaacaaatgtaaggaaggtatagtttttaaagatttttgacttgaattaaataggattggttacttcttgcccctcccgagggtggactgtgcacagaagagacctcttcaccgggtttgctgctctttttcgcactgtgagttggggttctaacagtcagcgttggtccataacaaaatggaaatcctttctttcccctcctgttaatgccccctgtctgtgcagtgactgtgcaaccagcaccttttgtggtcgaatcagccagcagaagtgcccctcgtgttcctggattctctcttctgtggttccatttctttgagtcctgggttctcgccctgaatggctcaacagggggaaaggcagacagcttcttcgtgccagaaacatttttttttttttttgaaatartgagccaagattgcgccactgcattccatcctcagcaacagarcaagactccaactcawaacaaaacaaaagattgargtwattgtggcaacacctgcctttttttctaagctgcaattctctactgttttcaagaaaaatacaagttagcctatttacagaatgttttgaattgactcctgtcctctggttaaaactcctcttgagataattgatagctgaaaaggtaggatggntctctcaaacttgacttccatctaaatcaacgctgagttgattaacttagatatcaagaaaaattgcctcattagnttacccctgaggagatgcctatgaaggtacatcctttttacaattaataagacagntttcacatgaagaaacaatttgaaatatttaataagaaaatggggtgaaggcaancattacggttgggaaaagaccatgcaagcctttatagaggataacgatttatatattcactattaatttggccgggtaataggaacct

SEQ ID NO: 130 - DNA, 1249 bp, Homo sapiens
  misc_feature (1217)..(1217): n equals a,t,g, or c
ggccaggcgggtctcaaactcctcgtctcaggtgatctgcttgcctcggcctcccaaagtgctgggattacaggcgtgagcactgcgcccagcctgagtttcattttttaagtcacatagcagtagtccttatttcagtgctagaccctttgaaatgcgatgaaagctatatggacccttcgctttgttatataacatatgcacacatacccagaattttgcacatatgttcagagattcctagacctgcagacctgcctctgtgtgtcccaatttaagaacctctgttctttcttcatgactggatttgcccaattttgtgttattttgggacttaatttgtccctctttgggacatttccttatttattgccctcttcagagagtagatgtagaaaataaagagaggaaacctagattacttaattttaatttaacattttctatagatagcataccacgccaagtgtgctctgtcttgatccccttctttctagcatctgccagacattgtagagtttcscaascagttgtaggtttgagctgcagccagtcatttcttttattctttaaaagtacatagatttgtctttttagggctttactgaaagtaaaatatcctgacatttaaactgacagatgtaggaggtaaaaaatagagttctgaaacatwtgaatttatgtgacagctgaagtcacgagatgaggkatgtatgtcccccagggaggwtgcagaaagaagaaaagggtactggaaacagcatgtcagtggtgccagctgagggctggaggcagccaggagagttgggagcctgggtgctgggtggagagaggttaacagggaakacatgggaagtattgtgaaggctggtgtgagcaggggactactccagccctgttggaacatagagccatttggcagattgacaatgcagtgacagctgtatataataaatgtgttgaaaggaggaaggtgaggattttcttggtgggagtttatgctgttatttaacatattttgcttccaaaggggttaagatgttttacctaaatggargtttctaggtcagtgctatacaatatttctaatctgtgttttatagtgtgagctacatatgtaattttaaaattttcaagtagccacataataaaggaaacaggtgaaatttaaaaaaaaaaaaaaaaaaaaaaaaaaaaaaaaaaaaaaaaaaaaaaanaaaaaaaaaaaaaaaaaaaaaaaaaaaaaaaa

SEQ ID NO: 131 - DNA, 1660 bp, Homo sapiens
ccgggtcgacccacgcgtccggcccgcggaaggcgacatgggctccgctccctgggccccggtcctgctgctggcgctcgggctgcgcggcctccaggcgggggcccgcagcggaccccggcttccaggagcgcttcttccagcagcgtctggaccacttcaacttcgagcgcttcggcaacaagaccttccctcagcgcttcctggtgtcggacaggttctgggtccggggcgaggggcccatcttcttctacactgggaacgagggcgacgtgtgggccttcgccaacaactcggccttcgtcgcggactggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaagttatggggggatgctcagtgcctacctgaggatgaagtatccccacctggtggcgggggcgctggcggccagcgcgcccgttctatctgtggcaggcctcggcgactccaaccagttcttccgggacgtcacggcggactttgagggccagagtcccaaatgcacccagggtgtgcgggaagcgttccgacagatcaaggacttgttcctacagggagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcagggctggtctacaacgcctcgggctccgagcactgctacgacatctaccggctctaccacagctgtgctgaccccactggctgcggcaccggccccgacgccagggcctgggactaccaggcctgcaccgagatcaacctgaccttcgccagcaacaatgtgaccgatatgttcccggacctgcccttcactgacgagctccgccagcggtactgcctggacacctggggcgtgtggccccggcccgactggctgctgaccagcttctgggggggtgatctcagagccgccagcaacatcatcttctccaacgggaacctggacccctgggcagggggcgggattcggaggaacctgagtgcctcagtcatcgccgtcaccatccaggggggagcgcaccacctcgacctcagagcctcccacccagaagatcctgcttccgtggttgaggcgcggaagctggaggccaccatcatcggcgagtgggtaaaggcagccaggcgtgagcagcagccagctctgcgtggggggcccagactcagcctctgagcacaggactggaggggtctcaaggctcctcatggagtgggggcttcactcaagcagctggcggcagagggaaggggctgaataaacgcctggaggcctggccatgtaaaaaaaaaaaaaaaaaaaaaaaaaaaaaaaaaaaaaaaaaaa

SEQ ID NO: 132 - DNA, 2075 bp, Homo sapiens
ccacgcgtccgtggggccgagcgccgctgggtaggcggaagtagccgcagatggcggcggctatgcccttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccatcagacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacaccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctacggctccttctacaatctcctcacccgaacctttccacatcgaggagccccgcacaggtggcctggccaagcggctggccaaccttatccggcgcgcccgagtgtcccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtggttaaaaaaaaaaaaaaaaaaaaaaaaaaaaaaaaaaaaaa

SEQ ID NO: 133 - DNA, 1333 bp, Homo sapiens
gaattcggcacgagcccaggagtgcagtggtatgatcatagttcaccgtagcctcaaactcgtgggctcaagtgatcctccagccttaacctcccgaatagcctggcttataggtgcacgccacacacctgactgctcagtatgtaaatttttactatgcctaaggttgaccaccttttaatatgtttaggagccatttgtatttccttttgtttcccatattgttttgttcctatccatttttctactatatcgttgatatgttgtttatttgttagggatatgaaccctttgacagtaatgagttgcaaatattttctttccaatttgtcatctgtcttttgcttatgatggctttgtcatgagttttaaaaaatttttatgtagtctgaataccagtttttttagtggtttctggattttgagtcataattagaatgtwtttctcaatccagagcaatagagtaattcacctaaattctacatctaaattttgaacctctgaagcatattctggcataagatataagttatggatctaacctaattttttccgcaggtgattaacccagttgttccaatattatttattgaactgtttgttttttcctgacgagtttgagargctacattgatcttatcttagaatccgtcatatgtatttagctgtgtatctgcttctgtttctctgtatctgtttctatttcattgctctatttagtcatgcactartaccacattgttttaattacccaggctttagttttaatctagtgcattggtcctccctcattcctcccctgcccamcttttttttttttaacagtttttctaactgttccttatttttcccatatgrgctttaaaaaattcttaacatatagagcatactaaaactgtccaactcaagttctctcccaagggttgcacttttaaccacttattttgtcactgttcttttgatactttmcctgataaagatacactttttactacttttaaattattacagtgttctatttggcagtgcccaaacaggtgatggcagatagaggcaggatgcaatgcctgtgtggaaagaatgtcatctcagtgcttctattttaagatagtctctaggaatgatttaaggactgttctcatgtaaaatccctatttctttttttattccattacgaattatttgcccaaaagttggatatctgtcaaagattcataagacaagagggagagacccttaaataagtactaaacttgtaaaatcaatatgtggataaaagtgcaagtacaagaagttactttggaaaaaaaaaaaaaaaaaaaaaaaactcga

SEQ ID NO: 134 - protein, 56 aa, Homo sapiens
MAKTDFSIILLKLHCLFFFSVISVHCAQSFISVTQTEPSPAVCIFPAVGSGLGPCD

SEQ ID NO: 135 - protein, 41 aa, Homo sapiens
  SITE (3): Xaa equals any of the naturally occurring L-amino acids
MAXLDNCLMLLITSGTWLGSVARKTWQAICDSGSSGCALIR

SEQ ID NO: 136 - protein, 414 aa, Homo sapiens
MNPTLGLAIFLAVLLTVKGLLKPSFSPRNYKALSEVQGWKQRMAAKELARQNMDLGFKLLKKLAFYNPGRNIFLSPLSISTAFSMLCLGAQDSTLDEIKQGFNFRKMPEKDLHEGFHYIIHELTQKTQDLKLSIGNTLFIDQRLQPQRKFLEDAKNFYSAETILTNFQNLEMAQKQINDFISQKTHGKINNLIENIDPGTVMLLANYIFFRARWKHEFDPNVTKEEDFFLEKNSSVKVPMMFRSGIYQVGYDDKLSCTILEIPYQKNITAIFILPDEGKLKHLEKGLQVDTFSRWKTLLSRRVVDVSVPRLHMTGTFDLKKTLSYIGVSKIFEEHGDLTKIAPHRSLKVGEAVHKAELKMDERGTEGAAGTGAQTLPMETPLVVKIDKPYLLLIYSEKIPSVLFLGKIVNPIGK

SEQ ID NO: 137 - protein, 44 aa, Homo sapiens
MGQQSCWMGLGCWLSLSGLSGVVRASPRSPRPRRGAACGETLMP

SEQ ID NO: 138 - protein, 197 aa, Homo sapiens
MAGPWTFTLLCGLLAATLIQATLSPTAVLILGPKVIKEKLTQELKDHNATSILQQLPLLSAMREKPAGGIPVLGSLVNTVLKHIIWLKVITANILQLQVKPSANDQELLVKIPLDMVAGFNTPLVKTIVEFHMTTEAQATIRMDTSASGPTRLVLSDCATSHGSLRIQLLHKLSFLVNALAKQVMNLLVPSMPRWPN

SEQ ID NO: 139 - protein, 45 aa, Homo sapiens
  SITE (11): Xaa equals any of the naturally occurring L-amino acids
MHRQLLGFCFXFCFFFKRHCDCILLYLIGFVFLLTMVKIHLSEHS

SEQ ID NO: 140 - protein, 40 aa, Homo sapiens
MLKRVILLVEMFIHFLIYAKSFYHKSWEQLSFTHYLLQIS

SEQ ID NO: 141 - protein, 84 aa, Homo sapiens
  SITE (48): Xaa equals any of the naturally occurring L-amino acids
MPILVFSICLQCTLFRSEAIIFQEERNHQVTLLKAVKTKFQSGTGLRXPVLEYAKSIQIISKYTCGTVLPVFKMRRYYVGQKCQ

SEQ ID NO: 142 - protein, 200 aa, Homo sapiens
  SITE (144): Xaa equals any of the naturally occurring L-amino acids
  SITE (149): Xaa equals any of the naturally occurring L-amino acids
  SITE (160): Xaa equals any of the naturally occurring L-amino acids
  SITE (173): Xaa equals any of the naturally occurring L-amino acids
  SITE (177): Xaa equals any of the naturally occurring L-amino acids
  SITE (189): Xaa equals any of the naturally occurring L-amino acids
MFFLLCLVALEIKGFTFSARGARDRFLNKSGPQPGKKMKTTHCKQPLFSKPGQVRGALRKARGRQEEREAVGMWGGRGHSYPEYIKTSEVTEVRDSPKHPQVQPFLTTRVTCRVPGHLQVLEALCGAWGSMFKHALVVVQVPRXRGRAXLGSEWQVGQLXLILLHGTQHWAAXLVPXLPQESILPAQSXRVTNTPGTEET

SEQ ID NO: 143 - protein, 325 aa, Homo sapiens
MGSQVSSMLKLALQNCCPQLWQRHSARDRQCARVLADERSPQPGASPQEDIANFQVLVKILPVMVTLVPYWMVYFQMQSTYVLQGLHLHIPNIFPANPANISVALRAQGSSYTIPEAWLLLANVVVVLILVPLKDRLIDPLLLRCKLLPSALQKMALGMFFGFTSVIVAGVLEMERLHYIHHNETVSQQIGEVLYNAAPLSIWWQIPQYLLIGISEIFASIPGLEFAYSEAPRSMQGAIMGIFFCLSGVGSLLGSSLVALLSLPGGWLHCPKDFGNINNCRMDLYFFLLAGIQAVTALLFVWIAGRYERASQGPASHSRFSRDRG

SEQ ID NO: 144 - protein, 118 aa, Homo sapiens
  SITE (107): Xaa equals any of the naturally occurring L-amino acids
MVFVHLYLGNVLALLLFVHYSNGDESSDPGPQHRAQGPGPEPTLGPLTRLEGIKVGHERKVQLVTDRDHFIRTLSLKPLLFEIPGFLTDEECRLIIHLAQMKGLQRXRSCLLKSMKRQ

SEQ ID NO: 145 - protein, 47 aa, Homo sapiens
  SITE (8): Xaa equals any of the naturally occurring L-amino acids
  SITE (19): Xaa equals any of the naturally occurring L-amino acids
MKLTIFFXFPQTITGLLQXLMSRQVEDVAFLPLPHPVFSFSFFFPLV

SEQ ID NO: 146 - protein, 519 aa, Homo sapiens
  SITE (205): Xaa equals any of the naturally occurring L-amino acids
  SITE (207): Xaa equals any of the naturally occurring L-amino acids
  SITE (213): Xaa equals any of the naturally occurring L-amino acids
  SITE (225): Xaa equals any of the naturally occurring L-amino acids
MQGGQRPHLLLLLLAVCLGAQSRNQEERLLADLMRNYDPHLRPAERDSDVVNVSLKLTLTNLISLNEREEALTTNVWIEMQWCDYRLRWDPKDYEGLWILRVPSTMVWRPDIVLENNVDGVFEVALYCNVLVSPDGCIYWLPPAIFRSSCSISVTYFPFDWQNCSLIFQSQTYSTSEINLQLSQEDGQAIEWIFIDPEAFTENGXWXIRHRPXKMLLDSVAPAEXAGHQKVVFYLLIQRKPLFYVINIIAPCVLISSVAILIYFLPAKAGGQKCTVATNVLLAQTVFLFLVAKKVPETSQAVPLISKYLTFLMVVTILIVVNSVVVLNVSLRSPHTHSMARGVRKVFLRLLPQLLRMHVRPLAPAAVQDARFRLQNGSSSGWPIMAREEGDLCLPRSELLFRQRQRNGLVQAVLEKLENGPEVRQSQEFCGSLKQASPAIQACVDACNLMARARRQQSHFDSGNEEWLLVGRVLDRVCFLAMLSLFICGTAGIFLMAHYNQVPDLPFPGDPRPYLPLPD

SEQ ID NO: 147 - protein, 47 aa, Homo sapiens
MLLFSSRFIMFLWPPVSGVCLSFIRDRSFLPMCHFIYVLILCNSIAL

SEQ ID NO: 148 - protein, 431 aa, Homo sapiens
MSWVQATLLARGLCRAWGGTCGAALTGTSISQVPRRLPRGLHCSAAAHSSEQSLVPSPPEPRQRPTKALVPFEDLFGQAPGGERDKASFLQTVQKFAEHSVRKRGHIDFIYLALRKMREYGVERDLAVYNQLLNIFPKEVFRPRNIIQRIFVHYPRQQECGIAVLEQMENHGVMPNKETEFLLIQIFGRKSYPMLKLVRLKLWFPRFMNVNPFPVPRDLPQDPVELAMFGLRHMEPDLSARVTIYQVPLPKDSTGAADPPQPHIVGIQSPDQQAALARHNPARPVFVEGPFSLWLRNKCVYYHILRADLLPPEEREVEETPEEWNLYYPMQLDLEYVRSGWDNYEFDINEVEEGPVFAMCMAGAHDQATMAKWIQGLQETNPTLAQIPVVFRLAGSTRELQTSSAGLEEPPLPEDHQEEDDNLQRQQQGQS

SEQ ID NO: 149 - protein, 442 aa, Homo sapiens
  SITE (364): Xaa equals any of the naturally occurring L-amino acids
MWFTYLLLYLHSVRAYSSRGAGCCCCWARWRRAVHTARGLRGRPRRQLLRPLRPAQGLAPGRHRLRPAVLPLHLQPLPGLWGGHAEWAALLYYGPFIVIFQFGWASTQISHLSLIPELVTNDHEKVELTALRYAFTVVANITVYGAAWLLLHLQGSSRVEPTQDISISDQLGGQDVPVFRNLSLLVVGVGAVFSLLFHLGTRERRRPHAEEPGEHTPLLAPATAQPLLLWKHWLREPAFYQVGILYMTTRLIVNLSQTYMAMYLTYSLHLPKKFIATIPLVMYLSGFLSSFLMKPINKCIGRNMTYFSGLLVILAFAAWVALAEGLGVAVYAAAVLLGAGCATILVTSLAMTADLIGPHTNSGXFVYGSMSFLDKVANGLAVMAIQSLHPCPSELCCRACVSFYHWAMVAVTGGVGVAAALCLCSLLLWPTRLRRWDRDARP

SEQ ID NO: 150 - protein, 75 aa, Homo sapiens [sequence omitted]

SEQ ID NO: 151 - protein, 51 aa, Homo sapiens
MAGWFRGFFGFLFFFLCLFNLKLFKLKHSQMFGGKHPLKMGPCACLLGRRS

SEQ ID NO: 152 - protein, 209 aa, Homo sapiens
  SITE (3): Xaa equals any of the naturally occurring L-amino acids
  SITE (39): Xaa equals any of the naturally occurring L-amino acids
MAXSSRGNADSIVASLVLMVLYLIKKRLVACAAVFYGFXVHMKIYPVTYILPITLHLLPDRDNDKSLRQFRYTFQACLYELLKKLCNRAVLLFVAVAGLTFFALSFGFYYEYGWEFLEHTYFYHLTRRDIRHNFSPYFYMLYLTAESKWSFSLGIAAFLPQLILLSAVSFAYYRDLVFCCFLHTSIFVTFNKVCTSQYFLWVPLAYCLL

SEQ ID NO: 153 - protein, 218 aa, Homo sapiens
  SITE (168): Xaa equals any of the naturally occurring L-amino acids
  SITE (174): Xaa equals any of the naturally occurring L-amino acids
  SITE (198): Xaa equals any of the naturally occurring L-amino acids
  SITE (213): Xaa equals any of the naturally occurring L-amino acids
MRALLALCLLLGWLRWGPAGAQQSGEYCHGWVDVQGNYHEGFQCPEDFDTLDATICCGSCALRYCCAAADARLEQGGCTNDRRELEHPGITAQPVYVPFLIVGSIFIAFIILGSVVAIYCCTCLRPKEPSQQPIRFSLRSYQTETLPMILTSTSPRAPSRQSSTATSXSFTGGXIRRFFSAIWFPGVTPVFRLPPSAXAPTGWEELSRLSVPXDTPRP

SEQ ID NO: 154 - protein, 49 aa, Homo sapiens
  SITE (41): Xaa equals any of the naturally occurring L-amino acids
MGAHSFGFQLFMSVSVLWGRLCLYGRFSVITFASPPTTFMXIQCCSHCS

SEQ ID NO: 155 - protein, 40 aa, Homo sapiens
MHIHLDTSSLKTLHLGTLFFLFYLALTQNEENICDGKVTL

SEQ ID NO: 156 - protein, 107 aa, Homo sapiens
MPIIVLILVSLLSQLMVSNPPYSLYPRSGTGQTIKMQTENLGVVYYVNKDFKNEYKGMLLQKVEKSVEEDYVTNIRNNCWKERQQKTDMQYAAKVYRDDRLRRRQMP

SEQ ID NO: 157 - protein, 156 aa, Homo sapiens
MQASLWEPPRSGLPLWAEGLTFFYCYMLLLVLPCVALSEVSMQGEHIAPQKMMLYPVLSLATVNVVAVLARAANMALFRDSRVSAIFVGKNVVALATKACTFLEYRRQVRDFPPPALSLELQPPPPQRNSVPPPPPLHGPPGRPHMSSPTRDPLDT

SEQ ID NO: 158 - protein, 150 aa, Homo sapiens
MGYLFFLLFMICWMIYGCISYWGLHCETTYTKDGFWTYITQIATCSPWMFWMFLNSVFHFMWVAVLLMCQMYQISCLGITTNERMNARRYKHFKVTTTSIESPFNHGCVRNIIDFFEFRCCGLFRPVIVDWTRQYTIEYDQISGSGYQLV

SEQ ID NO: 159 - protein, 70 aa, Homo sapiens [sequence omitted]

SEQ ID NO: 160 - protein, 490 aa, Homo sapiens
  SITE (134): Xaa equals any of the naturally occurring L-amino acids
  SITE (389): Xaa equals any of the naturally occurring L-amino acids
MLALTFMFMVLEVVVSRVTSSLAMLSDSFHMLSDVLALVVALVAERFARRTHATQKNTFGWIRAEVMGALVNAIFLTGLCFAILLEAIERFIEPHEMQQPLVVLGVGVAGLLVNVLGLCLFHHHSGFSQDSGHXHSHGGHGHGHGLPKGPRVKSTRPGSSDINVAPGEQGPDQEETNTLVANTSNSNGLKLDPADPENPRSGDTVEVQVNGNLVREPDHMELEEDRAGQLNMRGVFLHVLGDALGSVIVVVNALVFYFSWKGCSEGDFCVNPCFPDPCKPFVEIINSTHASVYEAGPCWVLYLDPTLCVVMVCILLYTTYPLLKESALILLQTVPKQIDIRNLIKELRNVEGVEEVHELHVWQLAGSRIIATAHIKCEDPTSYMEVAKXIKDVFHNHGIHATTIQPEFASVGSKSSVVPCELACRTQCALKQCCGTLPQAPSGKDAEKTPAVSISCLELSNNLEKKPRRTKAENIPAVVIEIKNMPKQTT

SEQ ID NO: 161 - protein, 31 aa, Homo sapiens
MQPCVISWEQCSFVSPRGPHVYICFHDQRRF

SEQ ID NO: 162 - protein, 115 aa, Homo sapiens
  SITE (96): Xaa equals any of the naturally occurring L-amino acids
  SITE (100): Xaa equals any of the naturally occurring L-amino acids
MLGLLGSTALVGWITGAAVAVLLLLLLLATCLFHGRQDCDVERNRTAAGGNRVRRAQPWPFRRRGHLGIFHHHRHPGHVSHVPNVGLHHHHHPRHXPHHXHHHHHPHRHHPRHAR

SEQ ID NO: 163 - protein, 473 aa, Homo sapiens
MKRASAGGSRLLAWVLWLQAWQVAAPCPGACVCYNEPKVTTSCPQQGLQAVPVGIPAASQRIFLHGNRISHVPAASFRACRNLTILWLHSNVLARIDAAAFTGLALLEQLDLSDNAQLRSVDPATFHGLGRLHTLHLDRCGLQELGPGLFRGLAALQYLYLQDNALQALPDDTFRDLGNLTHLFLHGNRISSVPERAFRGLHSLDRLLLHQNRVAHVHPHAFRDLGRLMTLYLFANNLSALPTEALAPLRALQYLRLNDNPWVCDCRARPLWAWLQKFRGSSSEVPCSLPQRLAGRDLKRLAANDLQGCAVATGPYHPIWTGRATDEEPLGLPKCCQPDAADKASVLEPGRPASAGNALKGRVPPGDSPPGNGSGPRHINDSPFGTLPGSAEPPAHCSAARGLRATRFPTSGPRRRPGCSRKNRTRSHCRLGQAGSGGGGTGDSEGSGALPSLTCSLTPLGLALVLWTVLGPC

SEQ ID NO: 164 - protein, 91 aa, Homo sapiens
MRLCVTGPPVFFFFLNFFFFLCVGACLGDLKISRLVYLCKACLRLEYLGKESDSMLSEFLKGQKKNWRLLKCRFEVIFLKYYFGFCDIVKN

SEQ ID NO: 165 - protein, 44 aa, Homo sapiens
MKKHTKCQWLKMTILFLTVMKIGYGTSASCYRPEVLGLLMPHPL

SEQ ID NO: 166 - protein, 45 aa, Homo sapiens
MSCGCCFIHIYNLLLSLCYGLGVERVKFFTFSILKKETMLLNYLF

SEQ ID NO: 167 - protein, 128 aa, Homo sapiens
MLSSPILASGPAWLACSFSHVQWWVCLIAQVQFSAATVSPGRAGTGAAPSVPAVWAAEARGPSVPSTLQGSPVLQRDLANPPPKKKKKKKKKKKKKKKKKKKKKKKKKKKKKKKKKKKKKKKKKKGGP

SEQ ID NO: 168 - protein, 57 aa, Homo sapiens
MHPWRLSMCPACVLAALPALCSCLCSPDARPPHGWMSMPFTPHPLVSRAMPTCHPCS

SEQ ID NO: 169 - protein, 97 aa, Homo sapiens
MYRAIDSFPRWRSYFYFITLIFFLAWLVKNVFIAVIIETFAEIRVQFQQMWGSRSSTTSTATTQMFHEDAAGGWQLVAVGCQQAPGTRPSLPPGAVQ

SEQ ID NO: 170 - protein, 59 aa, Homo sapiens
MTSFCEMLKGSAAGCLVLLAFAFYLACSFSHKTKSHSHYALFILQDYLLGNFYYIPLSP

SEQ ID NO: 171 - protein, 42 aa, Homo sapiens
MSVAHMHACVFLCACVFCLAENALESVIILCYSYNKDEVREH

SEQ ID NO: 172 - protein, 54 aa, Homo sapiens
MKTHLLMFLLSCMARCTGIVPKRPQPAFPLRGRRRKNSFLFLLSFSIEFLLCVW

SEQ ID NO: 173 - protein, 53 aa, Homo sapiens
  SITE (11): Xaa equals any of the naturally occurring L-amino acids
MCKAVCKHRLXLFAVSSFSLGLGWVCVLVLMLWPVRLSLAPRPVQLQQRRSHC

SEQ ID NO: 174 - protein, 53 aa, Homo sapiens
MFTAPLFFFFFFEIINSMRNLGLNICLLCLLIEHHSRPSVCLPFTPKILTKKF

SEQ ID NO: 175 - protein, 48 aa, Homo sapiens
MLCFLPIPLLSILSPQTQASRLLDETVRRKHFLTYPFGISSIITQALL

SEQ ID NO: 176 - protein, 224 aa, Homo sapiens
  SITE (183): Xaa equals any of the naturally occurring L-amino acids
  SITE (214): Xaa equals any of the naturally occurring L-amino acids
MVLVALILLHSALAQSRRDFAPPGQQKREAPVDVLTQIGRSVRGTLDAWIGPETMHLVSESSSQVLWAISSAISVAFFALSGIAAQLLNALGLAGDYLAQGLKLSPGQVQTFLLWGAGALVVYWLLSLLLGLVLALLGRILWGLKLVIFLAGFVALMRSVPDPSTRALLLLALLILYALLSRXTGSRASGAQLEAKVRGLERQVEELRWRQRQXAKGARSVEEE

SEQ ID NO: 177 - protein, 200 aa, Homo sapiens
  SITE (10): Xaa equals any of the naturally occurring L-amino acids
  SITE (11): Xaa equals any of the naturally occurring L-amino acids
  SITE (27): Xaa equals any of the naturally occurring L-amino acids
  SITE (50): Xaa equals any of the naturally occurring L-amino acids
  SITE (60): Xaa equals any of the naturally occurring L-amino acids
  SITE (84): Xaa equals any of the naturally occurring L-amino acids
  SITE (178): Xaa equals any of the naturally occurring L-amino acids
  SITE (180): Xaa equals any of the naturally occurring L-amino acids
  SITE (190): Xaa equals any of the naturally occurring L-amino acids
MLQRMLIDVXXFLFLFAVWMVAFGVAXQGILRQNEQRWRWIFRSVIYEPXLAMFGQVPSXVDGTTYDFAHCTFTGNESKPLCVXLDEHNLPRFPEWITIPLVCIYMLSTNILLVNLLVAMFGYTVGTVQENNDQVWKFQRYFLVQEYCSRLNIPFPFIVFAYFYMVVKKCFKCCCKEXNXESSVCCSKMXTMRLWHGRVS

SEQ ID NO: 178 - protein, 93 aa, Homo sapiens
MPRATLWGHLSPAWVLVPWTPRACGQAAPGRGHVASDHKSGLPWPKHCSCLHPRASQPCLFSLNSNRTVFTAIQRVALGWTFWVQANLVPRCT

SEQ ID NO: 179 - protein, 404 aa, Homo sapiens
  SITE (41): Xaa equals any of the naturally occurring L-amino acids
  SITE (77): Xaa equals any of the naturally occurring L-amino acids
  SITE (96): Xaa equals any of the naturally occurring L-amino acids
  SITE (98): Xaa equals any of the naturally occurring L-amino acids
  SITE (108): Xaa equals any of the naturally occurring L-amino acids
  SITE (122): Xaa equals any of the naturally occurring L-amino acids
  SITE (124): Xaa equals any of the naturally occurring L-amino acids
  SITE (126): Xaa equals any of the naturally occurring L-amino acids
  SITE (175): Xaa equals any of the naturally occurring L-amino acids
  SITE (192): Xaa equals any of the naturally occurring L-amino acids
  SITE (210): Xaa equals any of the naturally occurring L-amino acids
  SITE (236): Xaa equals any of the naturally occurring L-amino acids
  SITE (239): Xaa equals any of the naturally occurring L-amino acids
  SITE (309): Xaa equals any of the naturally occurring L-amino acids
  SITE (335): Xaa equals any of the naturally occurring L-amino acids
  SITE (389): Xaa equals any of the naturally occurring L-amino acids
MHPIPSSFMIKAVSSFLTAEEASVGNPEGAFMKVLQARKNXTSTELIVEPEEPSDSSGINLSGFGSEQLDTNDESDXISTLSYILPYFSAVNLDVXSXLLPFIKLPTXGNSLAKIQTVGQNXQXVXRVLMGPRSIQKRHFKEVGRQSIRREQGAQASVENAAEEKRLGSPAPREXEQPHTQQGPEKLAGNAXYTKPSFTQEHKAAVSVLXPFSKGAPSTSSPAKALPQVRDRWKDXTHXISILESAKARVTNMKASKPISHSRKKYRFHKTRSRMTHRTPKVKKSPKFRKKSYLSRLMLANRPPFSAAXSLINSPSQGAFSSLGDLSPQENPFLXVSAPSEHFIETTNIKDTTARNALEENVFMENTNMPEVTISENTNYNHPPEADSXGTAFNLGPTVKQTET

SEQ ID NO: 180 - protein, 387 aa, Homo sapiens
  SITE (228): Xaa equals any of the naturally occurring L-amino acids
  SITE (359): Xaa equals any of the naturally occurring L-amino acids
MGAFLDKPKTEKHNAHGAGNGLRYGLSSMQGWRVEMEDAHTAVVGIPHGLEDWSFFAVYDGHAGSRVANYCSTHLLEHITTNEDFRAAGKSGSALELSVENVKNGIRTGFLKIDEYMRNFSDLRNGMDRSGSTAVGVMISPKHIYFINCGDSRAVLYRNGQVCFSTQDHKPCNPREKERIQNAGGSVMIQRVNGSLAVSRALGDYDYKCVDGKGPTEQLVSPEPEVYXILRAEEDEFIILACDGIWDVMSNEELCEYVKSRLEVSDDLENVCNWVVDTCLHKGSRDNMSIVLVCFSNAPKVSDEAVKKDSELDKHLESRVEEIMEKSGEEGMPDLAHVMRILSAENIPNLPPGGGLAGXRNVIEAVYSRLNPHRESDGGAGDLEDPW

SEQ ID NO: 181 - protein, 145 aa, Homo sapiens [sequence omitted]

SEQ ID NO: 182 - protein, 140 aa, Homo sapiens
  SITE (129): Xaa equals any of the naturally occurring L-amino acids
  SITE (132): Xaa equals any of the naturally occurring L-amino acids
  SITE (134): Xaa equals any of the naturally occurring L-amino acids
MFFSLPGLWQIASFTHNLIFHLWVWGSESGEHLQSHNDPDTRQGGHIPIRLLGESSASVPGSSEGHTGGPAPPRVGGSAGIIRTHVVFLVSWPLLQREQHRLSWKLPSVMWGDSREPHLARLDQSKWPXATXAXQYLGRG

SEQ ID NO: 183 - protein, 127 aa, Homo sapiens
MVPGAAGWCCLVLWLPACVAAHGFRIHDYLYFQVLSPGDIRYIFTATPAKDFGGIFHTRYEQIHLVPAEPPEACGELSNGFFIQDQIALVERGGCSFLSKTRVVQEHGGRAVIISDNALTMTASTWR

SEQ ID NO: 184 - protein, 146 aa, Homo sapiens
MQQSRLLLPFLFFLLEGCAPSSLGPGAAPGSGHSLGPPGSPGAPGPQPAVGPSSPCQPGPSPSSPAAAAASSQSSVASWPCTLRCAAPSPDASALRPAASPAATPAWSPGSGTIRVLRPPAPAAAPATAITNRGPPRRRRRNARTA

SEQ ID NO: 185 - protein, 68 aa, Homo sapiens
MKPTRSLWISFLMCCWIWFANILLRIFASVFFRDIGLKFSFFCCVSARLWYQDDAGLINELGRIPSFY

SEQ ID NO: 186 - protein, 51 aa, Homo sapiens [sequence omitted]

SEQ ID NO: 187 - protein, 85 aa, Homo sapiens
  SITE (68): Xaa equals any of the naturally occurring L-amino acids
MGMPLVTVTAATFPTLSCPPRAWPEVEAPEAPALPVVPELPEVPMEMPLVLPPELELLSLEAVHRYQXGGTLMGWTRAEASANGS

SEQ ID NO: 188 - protein, 191 aa, Homo sapiens
MGDHLDLLLGVVLMAGPVFGIPSCSFDGRIAFYRFCNLTQVPQVLNTTERLLLSFNYIRTVTASSFPFLEQLQLLELGSQYTPLTIDKEAFRNLPNLRILDLGSSKIYFLHPDAFQGLFHLFELRLYFCGLSDAVLKDGYFRNLKALTRLDLSKNQIRSLYLHPSFGKLNSLKSIDFSSNQIFLVCEHELE

SEQ ID NO: 189 - protein, 231 aa, Homo sapiens
MWALQLSLPTCGLAALLTHMRPCSSPYPHAGLAALLTHMGPCRSPYPHGGLAAVLTHMRALQLSLPTWGLAALLTHMRPCSSPYPHAGLACCWLWSLSSHRSLQVQATHRLVVRTIKDRVMLKVLPQTRRRGPFLSSCRNDVMRNCVPRHAVLVTTCVFVSFPTHCKVGITGPITQVKQKPGNHSSPCPVIQLVAKAEFELMLPSVPKPVYLTLVLSCWCLCDVPCLSVSL

SEQ ID NO: 190 - protein, 68 aa, Homo sapiens [sequence omitted]

SEQ ID NO: 191 - protein, 211 aa, Homo sapiens
  SITE (100): Xaa equals any of the naturally occurring L-amino acids
  SITE (103): Xaa equals any of the naturally occurring L-amino acids
MGEASPPAPARRHLLVLLLLLSTLVIPSAAAPIHDADAQESSLGLTGLQSLLQGFSRLFLKGNLLRGIDSLFSAPMDFRGLPGNYHKEENQEHQLGNNTXSSXLQIDKVPRMEEKEALVPIQKATDSFHTELHPRVAFWIIKLPRRRSHQDALEGGHWLSEKRHRLQAIRDGLRKGTHKDVLEEGTESSSHSRLSPRKTHLLYILRPSRQL

SEQ ID NO: 192 - protein, 90 aa, Homo sapiens [sequence omitted]

SEQ ID NO: 193 - protein, 62 aa, Homo sapiens
MELMALFFRTTTVAAMASRGALALFLRKILSEAKFKLSLTPQPPQPFYIYMAYYSENFFLKF

SEQ ID NO: 194 - protein, 295 aa, Homo sapiens
MLCCWFPWRILAAGQVPYSPHSPQVAGCDLTRCESGGARALSIQRAALVVLENYYKDFTIYNPNLLTASKFRAAKHMAGLKVYNVDGPSNNATGQSRAMIAAAARRRDSSHNELYYEEAEHERRVKKRKARLVVAVEEAFIHIQRLQAEEQQKAPGEVMDPREAAQAIFPSMARALQKYLRITRQQNYHSMESILQHLAFCITNGMTPKAFLERYLSAGPTLQYDKDRWLSTQWRLVSDEAVTNGLRDGIVFVLKCLDFSLVVNVKKIPFIILSEEFIDPKSHKFVLRLQSETSV

SEQ ID NO: 195 - protein, 295 aa, Homo sapiens
MGLPVSWAPPALWVLGCCALLLSLWALCTACRRPEDAVAPRKRARRQRARLQGSATAAEASLLRRTHLCSLSKSDTRLHELHRGPRSSRALRPASMDLLRPHWLEVSRDITGPQAAPSAFPHQELPRALPAAAATAGCAGLEATYSNVGLAALPGVSLAASPVVAEYARVQKRKGTHRSPQEPQQGKTEVTPAAQVDVLYSRVCKPKRRDPGPTTDPLDPKGQGAILALAGDLAYQTLPLRALDVDSGPLENVYESIRELGDPAGRSSTCGAGTPPASSCPSLGRGWRPLPASLP

SEQ ID NO: 196 - protein, 338 aa, Homo sapiens [sequence omitted]

SEQ ID NO: 197 - protein, 78 aa, Homo sapiens
MQQRGAAGSRGCALFPLLGVLFFQVSAPAGYAPLPAGGLGKMVAFPVPGRGVSRKPPHSSGKEGGRERDVGTMSSPPR

SEQ ID NO: 198 - protein, 181 aa, Homo sapiens
MMLMPYGALIIGFVCGIISTLGFVYLTPFLESRLHIQDTCGINNLHGIPGIIGGIVGAVTAASASLEVYGKEGLVHSFDFQGFNGDWTARTQGKFQIYGLLVTLAMALMGGIIVGLILRLPFWGQPSDENCFEDAVYWEMPEGNSTVYIPEDPTFKPSGPSVPSVPMVSPLPMASSVPLVP

SEQ ID NO: 199 - protein, 79 aa, Homo sapiens
MLSLDFLDDVRRMNKRQVSLSVLFFSWLFLSLRGCCCGARRTPGFWCEGLSWSDTRVIRFLWRLWPEAALSASLFLTPN

SEQ ID NO: 200 - protein, 69 aa, Homo sapiens
MEPRSFLLPELGGRVSHIPLGLTLVFACFLMVRETAGGFSFRAGDLEEISRKRTNVLGSLRGTELIGYI

SEQ ID NO: 201 - protein, 271 aa, Homo sapiens
MTQGKLSVANKAPGTEGQQQVHGEKKEAPAVPSAPPSYEEATSGEGMKAGAFPPAPTAVPLHPSWAYVDPSSSSSYDNGFPTGDHELFTTFSWDDQKVRRVFVRKVYTILLIQLLVTLAVVALFTFCDPVKDYVQANPGWYWASYAVFFATYLTLACCSGPRRHFPWEPDSPDRLYPVHGLPHWDAVQLLQHHLRAAVPGHHGPCLPLSHRLQLPDQVRLHLLPGRALRASHDSFLQRTHPGHPPTLPICALAPCSLCSTGSGCIYIVPGT

SEQ ID NO: 202 - protein, 51 aa, Homo sapiens
MKCTAVFAPSAWPNTLSLLVSLHTVMCINWHLVSASHMHIGRIVILEGDGM

SEQ ID NO: 203 - protein, 71 aa, Homo sapiens [sequence omitted]

SEQ ID NO: 204 - protein, 60 aa, Homo sapiens [sequence omitted]

SEQ ID NO: 205 - protein, 143 aa, Homo sapiens
MKWERGSPMVLLALVYDVCCASRRGGQSHPTSGSDVLPLPVPALAQPAQPSRLDACAKARGSQRAAGWPRAGSRLGPAVGRAASPSSLQTHGSSSQSSRQLPGPEMSSSPPWGQALPWPSSVNPSFLCAVSGLLTVVCVCARL

SEQ ID NO: 206 - protein, 148 aa, Homo sapiens
MQFILTGITLSGYLFTFSACAVLSASITVWGLMECLIHRHGSHTTEHLTRTLTSQQSSRGHLSLSHSTTQSNQPERTLALLTGGTADLSVWRQHSPKMGAIFQDAVFALDSQAYLWGIVSNRENIWVLEQWPPPKGFHSCQETPQESH

SEQ ID NO: 207 - protein, 36 aa, Homo sapiens
MWTCPGIAALVLMIVPGCSLCPAQVVHHVGQRESPS

SEQ ID NO: 208 - protein, 406 aa, Homo sapiens
MSGAPTAGAALMLCAATAVLLSAQGGPVQSKSPRFASWDEMNVLAHGLLQLGQGLREHAERTRSQLSALERRLSACGSACQGTEGSTDLPLAPESRVDPEVLHSLQTQLKAQNSRIQQLFHKVAQQQRHLEKQHLRIQHLQSQFGLLDHKHLDHEVAKPARRKRLPEMAQPVDPAHNVSRLHRLPRDCQELFQVGERQSGLFEIQPQGSPPFLVNCKMTSDGGWTVIQRRHDGSVDFNRPWEAYKAGFGDPHGEFWLGLEKVHSITGDRNSRLAVQLRDWDGNAELLQFSVHLGGEDTAYSLQLTAPVAGQLGATTVPPSGLSVPFSTWDQDHDLRRDKNCAKSLSGGWWFGTCSHSNLNGQYFRSIPQQRQKLKKGIFWKTWRGRYYPLQATTMLIQPMAAEAAS

SEQ ID NO: 209 - protein, 91 aa, Homo sapiens
MEKTLFLYHYLPALTFQILLLPVVLQHISDHLCRSQLQRSIFSALVVAWYSSACHVSNTLRPLTYGDKSLSPHELKALRWKDSWDILIRKH

SEQ ID NO: 210 - protein, 101 aa, Homo sapiens
  SITE (23): Xaa equals any of the naturally occurring L-amino acids
  SITE (29): Xaa equals any of the naturally occurring L-amino acids
MLLFGLCWGPYVATLLLSVLAYXQRPPLXPGTLLSLLSLGSASAAAVPVAMGLGDQRYTAPWRAAAQRCLQGLWGRASRDSPGPSIAYHPSSQSSVDLDLN

SEQ ID NO: 211 - protein, 50 aa, Homo sapiens [sequence omitted]

SEQ ID NO: 212 - protein, 161 aa, Homo sapiens
MTSALRGVADDQGQHPLLKMLLHLLAFSSAATGHLQASVLTQCLKVLVKLAENTSCDFLPRFQCVFQVLPKCLSPETPLPSVLLAVELLSLLADHDQLAPQLCSHSEGCLLLLLYMYITSRPDRVALETQWLQLEQEVVWLLAKLGVQEPLAPSHWLQLPV

SEQ ID NO: 213 - protein, 227 aa, Homo sapiens
  SITE (67): Xaa equals any of the naturally occurring L-amino acids
  SITE (170): Xaa equals any of the naturally occurring L-amino acids
MLGLLLLCTPRAWLTLSGPVCFQGRGPSEVPQRPPQLWVVSISVLQGQHRGRAGPRDEQERGRDQHXLPAHGRLHLSPRPEPGCRPACAAPGGQPGVVSGLPALGQPREASAPCHISRLRTASLAVVMGAEKGGAEMRPWPAVQAPAPLPSVGGTPICAPGCGSKDTVPXLQPSVPKGRAESGFVSARFLCPHPPRSLLCLGPGPSLSGLPGPPIPALLQGPLGLGC

SEQ ID NO: 214 - protein, 351 aa, Homo sapiens
MLTLRSLLFWSLVYCYCGLCASIHLLKLLWSLGKGPAQTFRRPAREHPPACLSDPSLGTHCYVRIKDSGLRFHYVAAGERGKPLMLLLHGFPEFWYSWRYQLREFKSEYRVVALDLRGYGETDAPIHRQNYKLDCLITDIKDILDSLGYSKCVLIGHDWGGMIAWLIAICYPEMVMKLIVINFPHPNVFTEYILRHPAQLLKSSYYYFFQIPWFPEFMFSINDFKVLKHLFTSHSTGIGRKGCQLTTEDLEAYIYVFSQPGALSGPINHYRNIFSCLPLKHHMVTTPTLLLWGENDAFMEVEMAEVTKIYVKNYFRLTILSEASHWLQQDQPDIVNKLIWTFLKEETRKKD

SEQ ID NO: 215 - protein, 93 aa, Homo sapiens
  SITE (59): Xaa equals any of the naturally occurring L-amino acids
  SITE (61): Xaa equals any of the naturally occurring L-amino acids
  SITE (84): Xaa equals any of the naturally occurring L-amino acids
MGHLPHILSLGLFLTLLMFCITKSDGQNKIYRCFKKASPQVIVTHTKMRIAAIICSYWXGXANLGTRIKLQLNSAVYKIFVSLXRKRKRTLSW

SEQ ID NO: 216 - protein, 101 aa, Homo sapiens
MFQQGWSSPLLTPAFTILPMSSLLTSLHPAPRLPTLLAASSPQLAPLTCCFQYPFLLSASSLGDIHPSSRDFSCHINSNVSELYFLPPTSVSLNVRIFYFQ

SEQ ID NO: 217 - protein, 98 aa, Homo sapiens
MGWLGRTCLAHSHLDFISGALLLTFAYFLVFQVCPVINKWLYNLDQHVVKELISKCWRWEGTGTLQKKAQNPPSPFVFHFPLPHSGTSPRPKISFLLK

SEQ ID NO: 218 - protein, 81 aa, Homo sapiens
MWGGSVFLKPKLLQAGGFLHFLFVLFLTADSVHLSVGGELLLRTGFKRHIPVTFKNLHGGRSFSRSVGWSTLGPTTLRRGR

SEQ ID NO: 219 - protein, 188 aa, Homo sapiens
MFHQIWAALLYFYGIILNSIYQCPEHSQLTTLGVDGKEFPEVHLGQWYFIAGAAPTKEELATFDPVDNIVFNMAAGSAPMQLHLRATIRMKDGLCVPRKWIYHLTEGSTDLRTEGRPDMKTELFSSSCPGGIMLNETGQGYQRFLLYNRSPHPPEKCVEEFKSLTSCLDSKAFLLTPRNQEACELSNN

SEQ ID NO: 220 - protein, 44 aa, Homo sapiens
MQRTFKYLHFYIIRFVSTYAFIVFFPFSSSHVNGPCEKNIPLGK

SEQ ID NO: 221 - protein, 515 aa, Homo sapiens
MGSAPWAPVLLLALGLRGLQAGGEWRRPPAHSPVPAPPLRFASPHSPQAPDPGFQERFFQQRLDHFNFERFGNKTFPQRFLVSDRFWVRGEGPIFFYTGNEGDVWAFANNSGFVAELAAERGALLVFAEHRYYGKSLPFGAQSTQRGHTELLTVEQALADFAELLRALRRDLGAQDAPAIAFGGSYGGMLSAYLRMKYPHLVAGALAASAPVLAVAGLGDSNQFFRDVTADFEGQSPKCTQGVREAFRQIKDLFLQGAYDTVRWEFGTCQPLSDEKDLTQLFMFARNAFTVLAMMDYPYPTDFLGPLPANPVKVGCDRLLSEAQRITGLRALAGLVYNASGSEHCYDIYRLYHSCADPTGCGTGPDARAWDYQACTEINLTFASNNVTDMFPDLPFTDELRQRYCLDTWGVWPRPDWLLTSFWGGDLRAASNIIFSNGNLDPWAGGGIRRNLSASVIAVTIQGGAHHLDLRASHPEDPASVVEARKLEATIIGEWVKAARREQQPALRGGPRLSL

SEQ ID NO: 222 - protein, 522 aa, Homo sapiens
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSDTDHYFLRYAVLPREVVCTENLTPWKKLLPCSSKAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSMPYNVICLTCTVVAVCYGSFYNLLTRTFHIEEPRTGGLAKRLANLIRRARGVPPL

SEQ ID NO: 223 - protein, 52 aa, Homo sapiens
MKSHISWRLCSLLLILFSLILSACFISARWSSNSDIFFSAWSIQLLILVYAS

SEQ ID NO: 224 - protein, 73 aa, Homo sapiens
  SITE (24): Xaa equals any of the naturally occurring L-amino acids
MGFWCGCPFCLLVFLLTVRTRSFXSVGVCWRSTPDPLCLGISSRSCRTADIGEQQMLLPDRSSGSFVSEYPAM

SEQ ID NO: 225 - protein, 54 aa, Homo sapiens
MYRFFLCVDLSFQLLWVIPRSTVTGTYGKDIFSLAGNHHTVFQSSCTILHTHQH

SEQ ID NO: 226 - protein, 72 aa, Homo sapiens
MATILLKLPILSAMIKKPLRNYLKTSETTMEKIIIQKLVANLKFLPLGTLQLAMMIANLIKKLFFPLVKAAK

SEQ ID NO: 227 - protein, 66 aa, Homo sapiens
MYLAVYLLLFLCICFYFIALFSHALVPHCFNYPGFSFNLVHWSSLIPPLPTFFFFNSFSNCSYFSI

SEQ ID NO: 228 - protein, 56 aa, Homo sapiens; identical to SEQ ID NO: 134

SEQ ID NO: 229 - protein, 76 aa, Homo sapiens
MAGPWTFTLLCGLLAATLIQATLSPTAVLILGPKVIKEKLTQELKDHNATSILQQLPLLSAMREKPAGASLCWAAW

SEQ ID NO: 230 - protein, 44 aa, Homo sapiens [sequence omitted]

SEQ ID NO: 231 - protein, 101 aa, Homo sapiens
  SITE (47): Xaa equals any of the naturally occurring L-amino acids
  SITE (98): Xaa equals any of the naturally occurring L-amino acids
MSWVQATLLARGLCRAWGGTCGAALTGTSISQVPRRLPRGLHCSALXIALNSPWFPAHRNPGRGPPRLWCPLRTCLGRRLVGNGTRRASCRRCRNLRXQRA

SEQ ID NO: 232 - protein, 132 aa, Homo sapiens
MTYFSGLLVILAFAAWVALAEGLGVAVYAAAVLLGAGCATILVTSLAMTADLIGPHTNSGAFVYGSMSFLDKVANGLAVMAIQSLHPCPSELCCRACVSFYHWAMVAVTGGVGVAAALCLCSLLLWPTRLRR

SEQ ID NO: 233 - protein, 66 aa, Homo sapiens
MTYFSGLLVILAFAAWVALAEGLGVAVYAAAVLLGAGCATILVTSLAMTADLIGPHTNSGLSCTAP

SEQ ID NO: 234 - protein, 72 aa, Homo sapiens
MPWKRAVVLLMLWFIGQAMWLAPAYVLEFQGKNTFLFIWLAGLFFLLINCSILIQIISHYKEEPLTERIKYD

SEQ ID NO: 235 - protein, 293 aa, Homo sapiens
  SITE (134): Xaa equals any of the naturally occurring L-amino acids
MLALTFMFMVLEVVVSRVTSSLAMLSDSFHMLSDVLALVVALVAERFARRTHATQKNTFGWIRAEVMGALVNAIFLTGLCFAILLEAIERFIEPHEMQQPLVVLGVGVAGLLVNVLGLCLFHHHSGFSQDSGHXHSHGGHGHGHGLPKGPRVKSTRPGSSDINVAPGEQGPDQEETNTLVANTSNSNGLKLDPADPENPRSGDTVEVQVNGNLVREPDHMELEEDRAGQLNMRGVFLHVLGDALGSVIVVVNALVFYFSWKGCSEGDFCVNPCFPDPCKAFVEILIVLMHQFM

SEQ ID NO: 236 - protein, 550 aa, Homo sapiens
MKRASAGGSRLLAWVLWLQAWQVAAPCPGACVCYNEPKVTTSCPQQGLQAVPVGIPAASQRIFLHGNRISHVPAASFRACRNLTILWLHSNVLARIDAAAFTGLALLEQLDLSDNAQLRSVDPATFHGLGRLHTLHLDRCGLQELGPGLFRGLAALQYLYLQDNALQALPDDTFRDLGNLTHLFLHGNRISSVPERAFRGLHSLDRLLLHQNRVAHVHPHAFRDLGRLMTLYLFANNLSALPTEALAPLRALQYLRLNDNPWVCDCRARPLWAWLQKFRGSSSEVPCSLPQRLAGRDLKRLAANDLQGCAVATGPYHPIWTGRATDEEPLGLPKCCQPDAADKASVLEPGRPASAGNALKGRVPPGDSPPGNGFWPKGTLMTYPFGTLPGLAEPPVSALRPEGSEPPGSPLRALRRRPGCSRKNRTRSHAVWARQAAGVAGLVTQKAQVPYPASPAASPPWAWRWCCGQCLGPADPQRTQERAQQPGVCTYGVSLHAAKPAGRPTRGAGQARSSLMDACRPPPPSPPHHVYRVRRQRLFQNAASHPDRGI

SEQ ID NO: 237 - protein, 380 aa, Homo sapiens
MKRASAGGSRLLAWVLWLQAWQVAAPCPGACVCYNEPKVTTSCPQQGLQAVPVGIPAASQRIFLHGNRISHVPAASFRACRNLTILWLHSNVLARIDAAAFTGLALLEQLDLSDNAQLRSVDPATFHGLGRLHTVHLDRCGLQELGPGLFRGLAALQYLYLQDNALQALPDDTFRDLGNLTHLFLHGNRISSVPERAFRGLHSLDRLLLHQNRVAHVHPHAFRDLGRLMTLYLFANNLSALPTEALAPLRALQYLRLNDNPWVCDCRARPLWAWLQKFRGSSSEVPCSLPQRLAGRDLKRLAANDLQGCAVATGPYHPIWTGRATDEEPLGLPKCCQPDAADKASVLEPGRPASAGNALKGPRAGRGQARRETVFGPREH

SEQ ID NO: 238 - protein, 54 aa, Homo sapiens; identical to SEQ ID NO: 172

SEQ ID NO: 239 - protein, 47 aa, Homo sapiens
MKTHLLMFLLSCMARCTGIVPKRPQPAFPLRGKEKKKLLFIFTFFQH

SEQ ID NO: 240 - protein, 53 aa, Homo sapiens
  SITE (41): Xaa equals any of the naturally occurring L-amino acids
MCKAVCKHRLRLFAVSSFSLGLGWVCVLVLMLWPVRLSLAXRPVQLQQRRSHC

SEQ ID NO: 241 - protein, 69 aa, Homo sapiens
MSRKSLAFPIICSYLCFLTVATCSIACTTVFFANLRHTRYICIELSALETSGVISPQINNVPEVHGKYS

SEQ ID NO: 242 - protein, 68 aa, Homo sapiens; identical to SEQ ID NO: 185

SEQ ID NO: 243 - protein, 67 aa, Homo sapiens
MGEASPPAPARRHLLVLLLLLSTLVIPSAAAPIHDADAQESSLGLTGLQSLLQGFSRLFLKVTCFGA

SEQ ID NO: 244 - protein, 90 aa, Homo sapiens [sequence omitted]

SEQ ID NO: 245 - protein, 140 aa, Homo sapiens
  SITE (117): Xaa equals any of the naturally occurring L-amino acids
MAFKLLILLIGTWALFFRKRRADMPRVFVFRALLLVLIFLFCGFPIGFFTGSAFWTLGNRNYQGIVQYAVSPCGMPSSFHPLLAIRPCWSSGSLQPNVPRCRLVPLPTEWGNPRFQXGTPEYPASSIGGPRKLLQRFHHL

SEQ ID NO: 246 - protein, 37 aa, Homo sapiens
MGLPVSWAPPALWVLGCCALLLSLWALCTACRSPRTL

SEQ ID NO: 247 - protein, 20 aa, Homo sapiens
RLLNLSVPMFTFIVVKRYAT

SEQ ID NO: 248 - protein, 138 aa, Homo sapiens
MAYLTGMLSSYYNTTSVLLCLGITALVCLSVTVFSFQTKFDFTSCQGVLFVLLMTLFFSGLILAILLPFQYVPWLHAVYAALGAGVFTLFLALDTQLLMGNRRHSLSPEEYIFGALNIYLDIIYIFTFFLQLFGTNRE

SEQ ID NO: 249 - protein, 175 aa, Homo sapiens [sequence omitted]

SEQ ID NO: 250 - protein, 101 aa, Homo sapiens [sequence omitted]

SEQ ID NO: 251 - protein, 39 aa, Homo sapiens
MLGLLLLCTPRAWLTLSGPVCFQGRDPLRSHRGHPSCGS

SEQ ID NO: 252 - protein, 47 aa, Homo sapiens
MLSIIPNDRLFINLIFLSNFLPSVLWEPAGQMWYTHVRYPSGRLLSL

SEQ ID NO: 253 - protein, 34 aa, Homo sapiens
MTGFAQFCVILGLNLSLFGTFPYLLPSSESRCRK

SEQ ID NO: 254 - protein, 490 aa, Homo sapiens
MGSAPWAPVLLLALGLRGLQAGARSGPRLPGALLPAASGPLQLRALRQQDLPSALPGVGQVLGPGRGAHLLLHWERGRRVGLRQQLGLRRGLAAERGALLVFAEHRYYGKSLPFGAQSTQRGHTELLTVEQALADFAELLRALRRDLGAQDAPAIAFGGSYGGMLSAYLRMKYPHLVAGALAASAPVLSVAGLGDSNQFFRDVTADFEGQSPKCTQGVREAFRQIKDLFLQGAYDTVRWEFGTCQPLSDEKDLTQLFMFARNAFTVLAMMDYPYPTDFLGPLPANPVKVGCDRLLSEAQRITGLRALAGLVYNASGSEHCYDIYRLYHSCADPTGCGTGPDARAWDYQACTEINLTFASNNVTDMFPDLPFTDELRQRYCLDTWGVWPRPDWLLTSFWGGDLRAASNIIFSNGNLDPWAGGGIRRNLSASVIAVTIQGGAHHLDLRASHPEDPASVVEARKLEATIIGEWVKAARREQQPALRGGPRLSL

SEQ ID NO: 255 - protein, 554 aa, Homo sapiens
GGGYALALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSDTDHYFLRYAVLPREVVCTENLTPWKKLLPCSSKAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSMPYNVICLTCTVVAVCYGSFYNLLTRTFPHRGAPHRWPGQAAGQPYPARPSVPPTLILALSSSCSCRFSLGRGAQGLFLPLALLRVGF

SEQ ID NO: 256 - protein, 69 aa, Homo sapiens
  SITE (26): Xaa equals any of the naturally occurring L-amino acids
  SITE (51): Xaa equals any of the naturally occurring L-amino acids
  SITE (68): Xaa equals any of the naturally occurring L-amino acids
MYLAVYLLLFLCICFYFIALFSHALXPHCFNYPGFSFNLVHWSSLIPPLPXFFFFNSFSNCSLFFPYXL

SEQ ID NO: 257 - protein, 21 aa, Homo sapiens
TRPEKVQAPLKWFKFQILDPP

SEQ ID NO: 258 - protein, 272 aa, Homo sapiens
  SITE (51): Xaa equals any of the naturally occurring L-amino acids
  SITE (229): Xaa equals any of the naturally occurring L-amino acids
SAEFGVAPLPGRRGSPVRQLAQFRRRLLRGSGGRGAPGRPPRCPGEARVMXPPSCIQDEPFPHPLEPEPGVSAQPGPGKPSDKRFRLWYVGGSCLDHRTTLPMLPWLMAEIRRRSQKPEAGGCGAPAAREVILVLSAPFLRCVPAPGAGASGGTSPSATQPNPAVFIFEHKAQHISRFIHNSHDLTYFAYLIKAQPDDPESQMACHVFRATDPSQVPDVISSIRQLSKXAMKEDAKPSKDNEDAFYNSQKFEVLYCGKVTVTPQEGPLKPHR

SEQ ID NO: 259 - protein, 14 aa, Homo sapiens
PMLPWLMAEIRRRS

SEQ ID NO: 260 - protein, 19 aa, Homo sapiens
IHNSHDLTYFAYLIKAQPD

SEQ ID NO: 261 - protein, 12 aa, Homo sapiens
KFEVLYCGKVTV

SEQ ID NO: 262 - protein, 13 aa, Homo sapiens
ISSIRQLSKAMKE

SEQ ID NO: 263 - protein, 20 aa, Homo sapiens
GERRNWGGEVYYSTGYSSRK

SEQ ID NO: 264 - protein, 9 aa, Homo sapiens
EPGAAQESW

SEQ ID NO: 265 - protein, 202 aa, Homo sapiens
  SITE (108): Xaa equals any of the naturally occurring L-amino acids
  SITE (120): Xaa equals any of the naturally occurring L-amino acids
  SITE (138): Xaa equals any of the naturally occurring L-amino acids
  SITE (165): Xaa equals any of the naturally occurring L-amino acids
LCARPSCSYTGAENQGQPRSPGWGSSHVGWGWGVGSPFLGSQEWSGLAPDLPDQEEEQPVGRHSCPDMSQCIKRGHQPVGFSKHAWRCLVGCCPWEEEKRSCHPFGAXLLWVLRFALQPXVYEDPAALDGGEEGMDIXTHILALAPRLLKDSGSIFLEVDPRHPXLVSSWLQSRPDLYLNLVAVRRDFCGRPRFLHIRRSGP

SEQ ID NO: 266 - protein, 37 aa, Homo sapiens
LCARPSCSYTGAENQGQPRSPGWGSSHVGWGWGVGSP

SEQ ID NO: 267 - protein, 37 aa, Homo sapiens
FLGSQEWSGLAPDLPDQEEEQPVGRHSCPDMSQCIKR

SEQ ID NO: 268 - protein, 37 aa, Homo sapiens
  SITE (34): Xaa equals any of the naturally occurring L-amino acids
GHQPVGFSKHAWRCLVGCCPWEEEKRSCHPFGAXLLW

SEQ ID NO: 269 - protein, 37 aa, Homo sapiens
  SITE (9): Xaa equals any of the naturally occurring L-amino acids
  SITE (27): Xaa equals any of the naturally occurring L-amino acids
VLRFALQPXVYEDPAALDGGEEGMDIXTHILALAPRL

SEQ ID NO: 270 - protein, 54 aa, Homo sapiens
  SITE (17): Xaa equals any of the naturally occurring L-amino acids
LKDSGSIFLEVDPRHPXLVSSWLQSRPDLYLNLVAVRRDFCGRPRFLHIRRSGP

SEQ ID NO: 271 - protein, 19 aa, Homo sapiens
QELLVKIPLDMVAGFNTPL

SEQ ID NO: 272 - protein, 26 aa, Homo sapiens
LRIQLLHKLSFLVNALAKQVMNLLVP

SEQ ID NO: 273 - protein, 20 aa, Homo sapiens
  SITE (2): Xaa equals any of the naturally occurring L-amino acids
  SITE (10): Xaa equals any of the naturally occurring L-amino acids
HXIWLKVITXNILQLQVKPS

SEQ ID NO: 274 - protein, 58 aa, Homo sapiens
AGPWTFTLLCGLLAATLIQATLSPTAVLILGPKVIKEKLTQELKDHNATSILQQLPLL

SEQ ID NO: 275 - protein, 15 aa, Homo sapiens
HFIITLTTFFTNYFL

SEQ ID NO: 276 - protein, 99 aa, Homo sapiens [sequence omitted]

SEQ ID NO: 277 - protein, 19 aa, Homo sapiens
RFWGSYEPHFSQEVSVIPP

SEQ ID NO: 278 - protein, 56 aa, Homo sapiens
  SITE (32): Xaa equals any of the naturally occurring L-amino acids
IRGNYFSGRKKSSSDTPKGSKDKISVWNRSQXACIRICKVHPNYIQIYLWHSATSF

SEQ ID NO: 279 - protein, 74 aa, Homo sapiens [sequence omitted]

SEQ ID NO: 280 - protein, 38 aa, Homo sapiens
FIQQNISFLLGYSIPVGCVGLAFFIFLFATPVFITKPP

SEQ ID NO: 281 - protein, 347 aa, Homo sapiens
  SITE (16): Xaa equals any of the naturally occurring L-amino acids
  SITE (340): Xaa equals any of the naturally occurring L-amino acids
  SITE (341): Xaa equals any of the naturally occurring L-amino acids
VSAHHPSGADEGVTAXQILPTEEYEEAMSTMQVSQLDLFRLLDQNRDGHLQLREVLAQTRLGNGWWMTPESIQEMYAAIKADPDGDGVLSLQEFSNMDLRDFHKYMRSHKAESSELVRNSHHTWLYQGEGAHHIMRAIRQRVLRLTRLSPEIVELSEPLQVVRYGEGGHYHAHVDSGPVYPETICSHTKLVANESVPFETSCRYMTVLFYLNNVTGGGETVFPVADNRTYDEMSLIQDDVDLRDTRRHCDKGNLRVKPQQGTAVFWYNYLPDGQGWVGDVDDYSLHGGCLVTRGTKWIANNWINVDPSRARQALFQQEMARLAREGGTDSQPEWALDRAXXDARVEL

SEQ ID NO: 282 - protein, 6 aa, Homo sapiens
AVFWYN

SEQ ID NO: 283 - protein, 18 aa, Homo sapiens
TVLFYLNNVTGGGETVFP

SEQ ID NO: 284 - protein, 59 aa, Homo sapiens
DLFRLLDQNRDGHLQLREVLAQTRLGNGWWMTPESIQEMYAAIKADPDGDGVLSLQEFS

SEQ ID NO: 285 - protein, 38 aa, Homo sapiens
  SITE (16): Xaa equals any of the naturally occurring L-amino acids
VSAHHPSGADEGVTAXQILPTEEYEEAMSTMQVSQLDL

SEQ ID NO: 286 - protein, 38 aa, Homo sapiens
FRLLDQNRDGHLQLREVLAQTRLGNGWWMTPESIQEMY

SEQ ID NO: 287 - protein, 38 aa, Homo sapiens
AAIKADPDGDGVLSLQEFSNMDLRDFHKYMRSHKAESS

SEQ ID NO: 288 - protein, 38 aa, Homo sapiens
ELVRNSHHTWLYQGEGAHHIMRAIRQRVLRLTRLSPEI

SEQ ID NO: 289 - protein, 38 aa, Homo sapiens
VELSEPLQVVRYGEGGHYHAHVDSGPVYPETICSHTKL

SEQ ID NO: 290 - protein, 38 aa, Homo sapiens
VANESVPFETSCRYMTVLFYLNNVTGGGETVFPVADNR

SEQ ID NO: 291 - protein, 38 aa, Homo sapiens
TYDEMSLIQDDVDLRDTRRHCDKGNLRVKPQQGTAVFW

SEQ ID NO: 292 - protein, 38 aa, Homo sapiens
YNYLPDGQGWVGDVDDYSLHGGCLVTRGTKWIANNWIN

SEQ ID NO: 293 - protein, 43 aa, Homo sapiens
  SITE (36): Xaa equals any of the naturally occurring L-amino acids
  SITE (37): Xaa equals any of the naturally occurring L-amino acids
VDPSRARQALFQQEMARLAREGGTDSQPEWALDRAXXDARVEL

SEQ ID NO: 294 - protein, 15 aa, Homo sapiens
LLADLMRNYDPHLRP

SEQ ID NO: 295 - protein, 19 aa, Homo sapiens
ISVTYFPFDWQNCSLIFQS

SEQ ID NO: 296 - protein, 16 aa, Homo sapiens
SMARGVRKVFLRLLPQ

SEQ ID NO: 297 - protein, 18 aa, Homo sapiens
QASPAIQACVDACNLMAR

SEQ ID NO: 298 - protein, 17 aa, Homo sapiens
YNQVPDLPFPGDPRPYL

SEQ ID NO: 299 - protein, 15 aa, Homo sapiens
CSISVTYFPFDWQNC

SEQ ID NO: 300 - protein, 18 aa, Homo sapiens
VLKYALFLVLKNYYYCPY

SEQ ID NO: 301 - protein, 315 aa, Homo sapiens
MREYGVERDLAVYNQLLNIFPKEVFRPRNIIQRIFVHYPRQQECGIAVLEQMENHGVMPNKETEFLLIQIFGRKSYPMLKLVRLKLWFPRFMNVNPFPVPRDLPQDPVELAMFGLRHMEPDLSARVTIYQVPLPKDSTGAADPPQPHIVGIQSPDQQAALARHNPARPVFVEGPFSLWLRNKCVYYHILRADLLPPEEREVEETPEEWNLYYPMQLDLEYVRSGWDNYEFDINEVEEGPVFAMCMAGAHDQATMAKWIQGLQETNPTLAQIPVVFRLAGSTRELQTSSAGLEEPPLPEDHQEEDDNLQRQQQGQS

SEQ ID NO: 302 - protein, 19 aa, Homo sapiens
FQFGWASTQISHLSLIPEL

SEQ ID NO: 303 - protein, 14 aa, Homo sapiens
LRYAFTVVANITVY

SEQ ID NO: 304 - protein, 17 aa, Homo sapiens
FVYGSMSFLDKVANGLA

SEQ ID NO: 305 - protein, 17 aa, Homo sapiens
WHLVGTVCVLLSFPFIF

SEQ ID NO: 306 - protein, 15 aa, Homo sapiens
GHFLNDLCASMWFTY

SEQ ID NO: 307 - protein, 40 aa, Homo sapiens
AIPLRVLVVLWAFVLGLSRVMLGRHNVTDVAFGFFLGYMQ

SEQ ID NO: 308 - protein, 13 aa, Homo sapiens
VGLSRVLGRHTDV

SEQ ID NO: 309 - protein, 17 aa, Homo sapiens
SFYKMKRNSYDRLRKVV

SEQ ID NO: 310 - protein, 39 aa, Homo sapiens
LHQLRPPHRFPLIPPAAAEGAGAPPGCGYCVFWLLNPLP

SEQ ID NO: 311 - protein, 72 aa, Homo sapiens; identical to SEQ ID NO: 234

SEQ ID NO: 312 - protein, 22 aa, Homo sapiens
ARAQPFAFQLRPAPGRPGSPVA

SEQ ID NO: 313 - protein, 297 aa, Homo sapiens
  SITE (12): Xaa equals any of the naturally occurring L-amino acids
  SITE (50): Xaa equals any of the naturally occurring L-amino acids
  SITE (79): Xaa equals any of the naturally occurring L-amino acids
  SITE (297): Xaa equals any of the naturally occurring L-amino acids
AGLPGALTAPAXHHHADSRPAELVVQPLSPPRPLLSHAGLASAAGASSLXRVPGEAESLCALSPGSALRFPAASCSRPXREPSGDEGTAGALPSPWLAALGPGGRPAVRRVLPRLGGRAGQLPRGLPVPRGLRHAGRYHLLRLLRAPLLLRRGRRQAGAGRLHQRPPRTGAPRHHCAACLRPLSHRRLHLHCVHHPGLCSGYLLLHLFETQGALAAANPLLTPQLSDRDPAHDPDLHQPQGTLPAVQHSHELQLHRRLHPQVLLSHLVSWCHPSISLTPFSRSPHWLGRAVQTFSSX

SEQ ID NO: 314 - protein, 38 aa, Homo sapiens
  SITE (12): Xaa equals any of the naturally occurring L-amino acids
AGLPGALTAPAXHHHADSRPAELVVQPLSPPRPLLSHA

SEQ ID NO: 315 - protein, 40 aa, Homo sapiens
  SITE (12): Xaa equals any of the naturally occurring L-amino acids
GLASAAGASSLXRVPGEAESLCALSPGSALRFPAASCSRP

SEQ ID NO: 316 - protein, 40 aa, Homo sapiens
  SITE (1): Xaa equals any of the naturally occurring L-amino acids
XREPSGDEGTAGALPSPWLAALGPGGRPAVRRVLPRLGGR

SEQ ID NO: 317 - protein, 40 aa, Homo sapiens
AGQLPRGLPVPRGLRHAGRYHLLRLLRAPLLLRRGRRQAG

SEQ ID NO: 318 - protein, 40 aa, Homo sapiens
AGRLHQRPPRTGAPRHHCAACLRPLSHRRLHLHCVHHPGL

SEQ ID NO: 319 - protein, 40 aa, Homo sapiens
CSGYLLLHLFETQGALAAANPLLTPQLSDRDPAHDPDLHQ

SEQ ID NO: 320 - protein, 59 aa, Homo sapiens
  SITE (59): Xaa equals any of the naturally occurring L-amino acids
PQGTLPAVQHSHELQLHRRLHPQVLLSHLVSWCHPSISLTPFSRSPHWLGRAVQTFSSX

SEQ ID NO: 321 - protein, 28 aa, Homo sapiens
VAHTCNLSTLGGQGGRIERTAGQEFKTS

SEQ ID NO: 322 - protein, 115 aa, Homo sapiens
HYKSYACRYRSGIRGRVDEVLTNCHWTYLKQNRKMAANSSGQALHSRDPLLIRTSGITLSSSILQPNRRQLCSMLMHIHLDTSSLKTLHLGTLFFLFYLALTQNEENICDGKVTL

SEQ ID NO: 323 - protein, 19 aa, Homo sapiens
TIKMQTENLGVVYYVNKDF

SEQ ID NO: 324 - protein, 13 aa, Homo sapiens
VEEDYVTNIRNNC

SEQ ID NO: 325 - protein, 7 aa, Homo sapiens
MVSNPPY

SEQ ID NO: 326 - protein, 5 aa, Homo sapiens
HASEL

SEQ ID NO: 327 - protein, 129 aa, Homo sapiens
RESWYACRYRSGIPGSTHASELMPIIVLILVSLLSQLMVSNPPYSLYPRSGTGQTIKMQTENLGVVYYVNKDFKNEYKGMLLQKVEKSVEEDYVTNIRNNCWKERQQKTDMQYAAKVYRDDRLRRRQMP

SEQ ID NO: 328 - protein, 35 aa, Homo sapiens
LVALDRMEYVRTFRKREDLRGRLFWVALDLLDLLD

SEQ ID NO: 329 - protein, 88 aa, Homo sapiens
  SITE (21): Xaa equals any of the naturally occurring L-amino acids
SVALFYNFGKSWKSDPGIIKXTEEQKKKTIVELAETGSLDLSIFCSTCLIRKPVRSKHCGVCNRCIAKFDHHCPWVGNCVGAGNHRYF

SEQ ID NO: 330 - protein, 12 aa, Homo sapiens
FDHHCPWVGNCV

SEQ ID NO: 331 - protein, 20 aa, Homo sapiens
QMYQISCLGITTNERMNARR

SEQ ID NO: 332 - protein, 12 aa, Homo sapiens
RVTSSLAMLSDS

SEQ ID NO: 333 - protein, 15 aa, Homo sapiens
AIERFIEPHEMQQPL

SEQ ID NO: 334 - protein, 49 aa, Homo sapiens
NALVFYFSWKGCSEGDFCVNPCFPDPCKPFVEIINSTHASVYEAGPCWV

SEQ ID NO: 335 - protein, 307 aa, Homo sapiens
  SITE (148): Xaa equals any of the naturally occurring L-amino acids
AGIRHERNRGRLLCMLALTFMFMVLEVVVSRVTSSLAMLSDSFHMLSDVLALVVALVAERFARRTHATQKNTFGWIRAEVMGALVNAIFLTGLCFAILLEAIERFIEPHEMQQPLVVLGVGVAGLLVNVLGLCLFHHHSGFSQDSGHXHSHGGHGHGHGLPKGPRVKSTRPGSSDINVAPGEQGPDQEETNTLVANTSNSNGLKLDPADPENPRSGDTVEVQVNGNLVREPDHMELEEDRAGQLNMRGVFLHVLGDALGSVIVVVNALVFYFSWKGCSEGDFCVNPCFPDPCKAFVEILIVLMHQFM

SEQ ID NO: 336 - protein, 504 aa, Homo sapiens
  SITE (148): Xaa equals any of the naturally occurring L-amino acids
  SITE (403): Xaa equals any of the naturally occurring L-amino acids
AGIRHERNRGRLLCMLALTFMFMVLEVVVSRVTSSLAMLSDSFHMLSDVLALVVALVAERFARRTHATQKNTFGWIRAEVMGALVNAIFLTGLCFAILLEAIERFIEPHEMQQPLVVLGVGVAGLLVNVLGLCLFHHHSGFSQDSGHXHSHGGHGHGHGLPKGPRVKSTRPGSSDINVAPGEQGPDQEETNTLVANTSNSNGLKLDPADPENPRSGDTVEVQVNGNLVREPDHMELEEDRAGQLNMRGVFLHVLGDALGSVIVVVNALVFYFSWKGCSEGDFCVNPCFPDPCKPFVEIINSTHASVYEAGPCWVLYLDPTLCVVMVCILLYTTYPLLKESALILLQTVPKQIDIRNLIKELRNVEGVEEVHELHVWQLAGSRIIATAHIKCEDPTSYMEVAKXIKDVFHNHGIHATTIQPEFASVGSKSSVVPCELACRTQCALKQCCGTLPQAPSGKDAEKTPAVSISCLELSNNLEKKPRRTKAENIPAVVIEIKNMPKQTT

SEQ ID NO: 337 - protein, 254 aa, Homo sapiens
  SITE (130): Xaa equals any of the naturally occurring L-amino acids
MFTFASMTKEDSKLIALIWPSEWQMIQKLFVVDHVIKITRIEVGDVNPSETQYISEPKLCPECREGLLCQQQRDLREYTQATIYVHKVVDNKKVMKDSAPELNVSSSETEEDKEEAKPDGEKDPDFNQSXGGTKRQKISHQNYIAYQKQVIRRSMRHRKVRGEKALLVSANQTLKELKIQIMHAFSVAPFDQNLSIDGKILSDDCATLGTLGVIPESVILLKADEPIADYAAMDDVMQVCMPEEGFKGTGLLGH

SEQ ID NO: 338 - protein, 21 aa, Homo sapiens
SAPELNVSSSETEEDKEEAKP

SEQ ID NO: 339 - protein, 18 aa, Homo sapiens
KELKIQIMHAFSVAPFDQ

SEQ ID NO: 340 - protein, 58 aa, Homo sapiens
FQDKNRPCLSNWPEDTDVLYIVSQFFVEEWRKFVRKPTRCSPVSSVGNSALLCPHGGL

SEQ ID NO: 341 - protein, 42 aa, Homo sapiens
MFTFASMTKEDSKLIALIWPSEWQMIQKLFVVDHVIKITRIE

SEQ ID NO: 342 - protein, 42 aa, Homo sapiens
VGDVNPSETQYISEPKLCPECREGLLCQQQRDLREYTQATIY

SEQ ID NO: 343 - protein, 42 aa, Homo sapiens
VHKVVDNKKVMKDSAPELNVSSSETEEDKEEAKPDGEKDPDF

SEQ ID NO: 344 - protein, 42 aa, Homo sapiens
  SITE (4): Xaa equals any of the naturally occurring L-amino acids
NQSXGGTKRQKISHQNYIAYQKQVIRRSMRHRKVRGEKALLV

SEQ ID NO: 345 - protein, 42 aa, Homo sapiens
SANQTLKELKIQIMHAFSVAPFDQNLSIDGKILSDDCATLGT

SEQ ID NO: 346 - protein, 44 aa, Homo sapiens
LGVIPESVILLKADEPIADYAAMDDVMQVCMPEEGFKGTGLLGH

SEQ ID NO: 347 - protein, 312 aa, Homo sapiens
  SITE (188): Xaa equals any of the naturally occurring L-amino acids
FQDKNRPCLSNWPEDTDVLYIVSQFFVEEWRKFVRKPTRCSPVSSVGNSALLCPHGGLMFTFASMTKEDSKLIALIWPSEWQMIQKLFVVDHVIKITRIEVGDVNPSETQYISEPKLCPECREGLLCQQQRDLREYTQATIYVHKVVDNKKVMKDSAPELNVSSSETEEDKEEAKPDGEKDPDFNQSXGGTKRQKISHQNYIAYQKQVIRRSMRHRKVRGEKALLVSANQTLKELKIQIMHAFSVAPFDQNLSIDGKILSDDCATLGTLGVIPESVILLKADEPIADYAAMDDVMQVCMPEEGFKGTGLLGH

SEQ ID NO: 348 - protein, 18 aa, Homo sapiens
RGERSEELLGREGLSGSQ

SEQ ID NO: 349 - protein, 179 aa, Homo sapiens
  SITE (119): Xaa equals any of the naturally occurring L-amino acids
  SITE (123): Xaa equals any of the naturally occurring L-amino acids
  SITE (177): Xaa equals any of the naturally occurring L-amino acids
AEAAEGEKGVRSCWAERDCPAPRCWASWGAQPSWDGSQVLLWRSCCCCCCWPPAFSTDGRTVTWRGTVQLQGETESAGPSLGPSGGGATWESFTITVILATYLMCRMWASTTTTTPATXLTTXTTTTTPTATIPATLAEAAVAGACGQQLPLPSHLFPGQVDPMFPCGRMHLWGERXEQ

SEQ ID NO: 350 - protein, 268 aa, Homo sapiens
  SITE (83): Xaa equals any of the naturally occurring L-amino acids
  SITE (137): Xaa equals any of the naturally occurring L-amino acids
  SITE (141): Xaa equals any of the naturally occurring L-amino acids
GGQDGHFTSTCVLALPRHACHFWGSLGVTVTRRAVQPRKSTLALHSPNPSALQTQCSSILCCHSTLGHAMQMQLEQAPVYCSXRSPQRCILPHGNMGSTCPGNRWEGRGSCCPQAPATAASASVAGMVAVGVVVVVXVVRXVAGVVVVVEAHIRHMRYVARMTVMVKDSQVAPPPEGPRLGPADSVSPCSCTVPLHVTVLPSVEKAGGQQQQQQQDRHSSTCDPSHEGCAPQEAQHLGAGQSLSAQQLLTPFSPSAASAQPSQSLNFV

SEQ ID NO: 351 - protein, 12 aa, Homo sapiens
FHGLGRLHTVHL

SEQ ID NO: 352 - protein, 21 aa, Homo sapiens
AAFTGLALLEQLDLSDNAQLR

SEQ ID NO: 353 - protein, 9 aa, Homo sapiens
AFRGLHSLD

SEQ ID NO: 354 - protein, 12 aa, Homo sapiens
HEVPDAPRPTPT

SEQ ID NO: 355 - protein, 101 aa, Homo sapiens [sequence omitted]

SEQ ID NO: 356 - protein, 12 aa, Homo sapiens
IPQGTEKKLETV

SEQ ID NO: 357 - protein, 37 aa, Homo sapiens
NPRLPLPRGGSLRLLSSPANSNNAKAYPFSRFPSPIF

SEQ ID NO: 358 - protein, 48 aa, Homo sapiens
MVQEAPALVRLSLGSHRVKGPLPVLKLQPEGWSPSTLWSCASVWKDSC

SEQ ID NO: 359 - protein, 122 aa, Homo sapiens [sequence omitted]

SEQ ID NO: 360 - protein, 33 aa, Homo sapiens
FYFITLIFFLAWLVKNVFIAVIIETFAEIRVQF

SEQ ID NO: 361 - protein, 15 aa, Homo sapiens
SIFTVYEAASQEGWV

SEQ ID NO: 362 - protein, 21 aa, Homo sapiens
HEGTSIFTVYEAASQEGWVFL

SEQ ID NO: 363 - protein, 8 aa, Homo sapiens
CKTSFGLA

SEQ ID NO: 364 - protein, 122 aa, Homo sapiens
  SITE (73): Xaa equals any of the naturally occurring L-amino acids
MITLSSAFSAKQKTHAHKNTHACMCATDMANPKLVLHFEVIVALLSLLQTILSLLLGQRTWLAHLYVLSTENXALHTVGTQKHLLPHDWCFGKHCVSCRHHIFHRFCSIFSSTLKRSQGFEG

SEQ ID NO: 365 - protein, 13 aa, Homo sapiens
CAAPGNKTSHLAA

SEQ ID NO: 366 - protein, 24 aa, Homo sapiens
EHPLYRAGHLILQDRASCLPAMLL

SEQ ID NO: 367 - protein, 15 aa, Homo sapiens
LLDPSCSGSGMPSRQ

SEQ ID NO: 368 - protein, 23 aa, Homo sapiens
YSTCSLCQEENEDVVRDALQQNP

SEQ ID NO: 369 - protein, 470 aa, Homo sapiens
  SITE (277): Xaa equals any of the naturally occurring L-amino acids
  SITE (296): Xaa equals any of the naturally occurring L-amino acids
  SITE (301): Xaa equals any of the naturally occurring L-amino acids
  SITE (306): Xaa equals any of the naturally occurring L-amino acids
  SITE (324): Xaa equals any of the naturally occurring L-amino acids
  SITE (431): Xaa equals any of the naturally occurring L-amino acids
SATEHGAVCCSCRRVGRRGEPPGSIKGLVYSSNFQNVKQLYALVCETQRYSAVLDAVIASAGLLRAEKKLRPHLAKVLVYELLLGKGFRGGGGRWKALLGRHQARLKAELARLKVHRGVSRNEDLLEVGSRPGPASQLPRFVRVNTLKTCSDDVVDYFKRQGFSYQGRASSLDDLRALKGKHFLLDPLMPELLVFPAQTDLHEHPLYRAGHLILQDRASCLPAMLLDPPPGSHVIDACAAPGNKTSHLAALLKNQGKIFAFDLDAKRLASMATLLAXAGVSCCELAEEDFLAVSPXDPRYXEVHYXLLDPSCSGSGMPSRQLEXPGAGTPSPVRLHALAGFQQRALCHALTFPSLQRLVYSTCSLCQEENEDVVRDALQQNPGAFRLAPALPAWPHRGLSTFPGAEHCLRASPETTLSSGFFVAVIERVEXPSSASQAKASAPERTPSPAPKRKKRQQRAAAGACTPPCT

SEQ ID NO: 370 - protein, 429 aa, Homo sapiens
  SITE (236): Xaa equals any of the naturally occurring L-amino acids
  SITE (255): Xaa equals any of the naturally occurring L-amino acids
  SITE (260): Xaa equals any of the naturally occurring L-amino acids
  SITE (265): Xaa equals any of the naturally occurring L-amino acids
  SITE (418): Xaa equals any of the naturally occurring L-amino acids
YEPHSTHSRERAMTSHARVSLGPSRDPLERPHLAKVLVYELLLGKGFRGGGGRWKALLGRHQARLKAELARLKVHRGVSRNEDLLEVGSRPGPASQLPRFVRVNTLKTCSDDVVDYFKRQGFSYQGRASSLDDLRALKGKHFLLDPLMPELLVFPAQTDLHEHPLYRAGHLILQDRASCLPAMLLDPPPGSHVIDACAAPGNKTSHLAALLKNQGKIFAFDLDAKRLASMATLLAXAGVSCCELAEEDFLAVSPXDPRYXEVHYXLLDPSCSGSGMPSRQLEEPGAGTPSPVRLHALAGFQQRALCHALTFPSLQRLVYSTCSLCQEENEDVVRDALQQNPGAFRLAPALPAWPHRGLSTFPGAEHCLRASPETTLSSGFFVAVIERVEVPSSASQAKASAPERTPSPAPKRKKRQQXAAAGACTPPCT

SEQ ID NO: 371 - protein, 245 aa, Homo sapiens [sequence omitted]

SEQ ID NO: 372 - protein, 29 aa, Homo sapiens
CFARLLKSPLFTPVPTEISPFYNCAYYSA

SEQ ID NO: 373 - protein, 111 aa, Homo sapiens
  SITE (47): Xaa equals any of the naturally occurring L-amino acids
NREQKAKSQLLRSQLYSTLDLPYFFQCVGTRCTAVCVCVCVCVCVCXYLPIHWQVNLHLVYLAMLCFLPIPLLSILSPQTQASRLLDETVRRKHFLTYPFGISSIITQALL

SEQ ID NO: 374 - protein, 51 aa, Homo sapiens
PGPEAQPWPGPDLPAVGSRGPGRLLAAVSAPRLGLGLAGADPVGPEACHLP

SEQ ID NO: 375 - protein, 42 aa, Homo sapiens
  SITE (32): Xaa equals any of the naturally occurring L-amino acids
GRLRGPDEVGAPFHPGPATPGLADPLRPAEPXHWLPSLWGPT

SEQ ID NO: 376 - protein, 19 aa, Homo sapiens
PGPEAQPWPGPDLPAVGSR

SEQ ID NO: 377 - protein, 19 aa, Homo sapiens
  SITE (15): Xaa equals any of the naturally occurring L-amino acids
ATPGLADPLRPAEPXHWLP

SEQ ID NO: 378 - protein, 251 aa, Homo sapiens
  SITE (210): Xaa equals any of the naturally occurring L-amino acids
  SITE (241): Xaa equals any of the naturally occurring L-amino acids
QWPEKDPVMAASSISSPWGKHVFKAILMVLVALILLHSALAQSRRDFAPPGQQKREAPVDVLTQIGRSVRGTLDAWIGPETMHLVSESSSQVLWAISSAISVAFFALSGIAAQLLNALGLAGDYLAQGLKLSPGQVQTFLLWGAGALVVYWLLSLLLGLVLALLGRILWGLKLVIFLAGFVALMRSVPDPSTRALLLLALLILYALLSRXTGSRASGAQLEAKVRGLERQVEELRWRQRQXAKGARSVEEE

SEQ ID NO: 379 - protein, 116 aa, Homo sapiens
  SITE (2): Xaa equals any of the naturally occurring L-amino acids
  SITE (5): Xaa equals any of the naturally occurring L-amino acids
  SITE (7): Xaa equals any of the naturally occurring L-amino acids
  SITE (9): Xaa equals any of the naturally occurring L-amino acids
EXPRXIXGXNAPQVPVRNSRVDPRVRPRVRSLVFVLFCDEVRQWYVNGVNYFTDLWNVMDTLGLFYFIAGIVFRLHSSNKSSLYSGRVIFCLDYIIFTLRLIHIFTVSRNLGPKII

SEQ ID NO: 380 - protein, 12 aa, Homo sapiens
NILLVNLLVAMF

SEQ ID NO: 381 - protein, 10 aa, Homo sapiens
QVWKFQRYFL

SEQ ID NO: 382 - protein, 316 aa, Homo sapiens
  SITE (2): Xaa equals any of the naturally occurring L-amino acids
  SITE (5): Xaa equals any of the naturally occurring L-amino acids
  SITE (7): Xaa equals any of the naturally occurring L-amino acids
  SITE (9): Xaa equals any of the naturally occurring L-amino acids
  SITE (126): Xaa equals any of the naturally occurring L-amino acids
  SITE (127): Xaa equals any of the naturally occurring L-amino acids
  SITE (143): Xaa equals any of the naturally occurring L-amino acids
  SITE (166): Xaa equals any of the naturally occurring L-amino acids
  SITE (176): Xaa equals any of the naturally occurring L-amino acids
  SITE (200): Xaa equals any of the naturally occurring L-amino acids
  SITE (294): Xaa equals any of the naturally occurring L-amino acids
  SITE (296): Xaa equals any of the naturally occurring L-amino acids
  SITE (306): Xaa equals any of the naturally occurring L-amino acids
EXPRXIXGXNAPQVPVRNSRVDPRVRPRVRSLVFVLFCDEVRQWYVNGVNYFTDLWNVMDTLGLFYFIAGIVFRLHSSNKSSLYSGRVIFCLDYIIFTLRLIHIFTVSRNLGPKIIMLQRMLIDVXXFLFLFAVWMVAFGVAXQGILRQNEQRWRWIFRSVIYEPXLAMFGQVPSXVDGTTYDFAHCTFTGNESKPLCVXLDEHNLPRFPEWITIPLVCIYMLSTNILLVNLLVAMFGYTVGTVQENNDQVWKFQRYFLVQEYCSRLNIPFPFIVFAYFYMVVKKCFKCCCKEXNXESSVCCSKMXTMRLWHGRVS

SEQ ID NO: 383 - protein, 129 aa, Homo sapiens
MEFQNMYIQLFGFSFFIVIIVRMLLLGLCVSARQPVMPRATLWGHLSPAWVLVPWTPRACGQAAPGRGHVASDHKSGLPWPKHCSCLHPRASQPCLFSLNSNRTVFTAIQRVALGWTFWVQANLVPRCT

SEQ ID NO: 384 - protein, 417 aa, Homo sapiens
  SITE (54): Xaa equals any of the naturally occurring L-amino acids
  SITE (90): Xaa equals any of the naturally occurring L-amino acids
  SITE (109): Xaa equals any of the naturally occurring L-amino acids
  SITE (111): Xaa equals any of the naturally occurring L-amino acids
  SITE (121): Xaa equals any of the naturally occurring L-amino acids
  SITE (135): Xaa equals any of the naturally occurring L-amino acids
  SITE (137): Xaa equals any of the naturally occurring L-amino acids
  SITE (139): Xaa equals any of the naturally occurring L-amino acids
  SITE (188): Xaa equals any of the naturally occurring L-amino acids
  SITE (205): Xaa equals any of the naturally occurring L-amino acids
  SITE (223): Xaa equals any of the naturally occurring L-amino acids
  SITE (249): Xaa equals any of the naturally occurring L-amino acids
  SITE (252): Xaa equals any of the naturally occurring L-amino acids
  SITE (322): Xaa equals any of the naturally occurring L-amino acids
  SITE (348): Xaa equals any of the naturally occurring L-amino acids
  SITE (402): Xaa equals any of the naturally occurring L-amino acids
LLLCVTGVYSYGLMHPIPSSFMIKAVSSFLTAEEASVGNPEGAFMKVLQARKNXTSTELIVEPEEPSDSSGINLSGFGSEQLDTNDESDXISTLSYILPYFSAVNLDVXSXLLPFIKLPTXGNSLAKIQTVGQNXQXVXRVLMGPRSIQKRHFKEVGRQSIRREQGAQASVENAAEEKRLGSPAPREXEQPHTQQGPEKLAGNAXYTKPSFTQEHKAAVSVLXPFSKGAPSTSSPAKALPQVRDRWKDXTHXISILESAKARVTNMKASKPISHSRKKYRFHKTRSRMTHRTPKVKKSPKFRKKSYLSRLMLANRPPFSAAXSLINSPSQGAFSSLGDLSPQENPFLXVSAPSEHFIETTNIKDTTARNALEENVFMENTNMPEVTISENTNYNHPPEADSXGTAFNLGPTVKQTET

SEQ ID NO: 385 - protein, 94 aa, Homo sapiens
  SITE (66): Xaa equals any of the naturally occurring L-amino acids
CFSNAPKVSDEAVKKDSELDKHLESRVEEIMEKSGEEGMPDLAHVMRILSAENIPNLPPGGGLAGXRNVIEAVYSRLNPHRESDGGAGDLEDPW

SEQ ID NO: 386 - protein, 56 aa, Homo sapiens
CFSNAPKVSDEAVKKDSELDKHLESRVEEIMEKSGEEGMPDLAHVMRILSAENIPN

SEQ ID NO: 387 - protein, 26 aa, Homo sapiens
RNVIEAVYSRLNPHRESDGGAGDLED

SEQ ID NO: 388 - protein, 16 aa, Homo sapiens
DSELDKHLESRVEEIM

SEQ ID NO: 389 - protein, 24 aa, Homo sapiens
KSGEEGMPDLAHVMRILSAENIPN

SEQ ID NO: 390 - protein, 9 aa, Homo sapiens
CFSNAPKVS

SEQ ID NO: 391 - protein, 69 aa, Homo sapiens; identical to SEQ ID NO: 241

SEQ ID NO: 392 - protein, 16 aa, Homo sapiens
IQKMTRVRVVDNSALG

SEQ ID NO: 393 - protein, 14 aa, Homo sapiens
PRCIHVYKKNGVGK

SEQ ID NO: 394 - protein, 15 aa, Homo sapiens
GDQILLAIKGQKKKA

SEQ ID NO: 395 - protein, 15 aa, Homo sapiens
NPVGTRIKTPIPTSL

SEQ ID NO: 396 - protein, 171 aa, Homo sapiens
  SITE (20): Xaa equals any of the naturally occurring L-amino acids
VLIPSFSSSFLCSRGGPLPXDLSWDPMAFFTGLWGPFTCVSRVLSHHCFSTTGSLSAIQKMTRVRVVDNSALGNSPYHRAPRCIHVYKKNGVGKVGDQILLAIKGQKKKALIVGHCMPGPRMTPRFDSNNVVLIEDNGNPVGTRIKTPIPTSLRKREGEYSKVLAIAQNFV

SEQ ID NO: 397 - protein, 171 aa, Homo sapiens
ARVVQPAARAGMWAGGRSSCQAEVLRATRGGAARGNAAPGRALEMVPGAAGWCCLVLWLPACVAAHGFRIHDYLYFQVLSPGDIRYIFTATPAKDFGGIFHTRYEQIHLVPAEPPEACGELSNGFFIQDQIALVERGGCSFLSKTRVVQEHGGRAVIISDNALTMTASTWR

SEQ ID NO: 398 - protein, 188 aa, Homo sapiens
MVPGAAGWCCLVLWLPACVAAHGFRIHDYLYFQVLSPGDIRYIFTATPAKDFGGIFHTRYEQIHLVPAEPPEACGELSNGFFIQDQIALVERGGCSFLSKTRVVQEHGGRAVIISDNAVDNDSFYVEMIQDSTQRTADIPALFLLGRDGYMIRRSLEQHGLPWAIISIPVNVTSIPTFELLQPPWTFW

SEQ ID NO: 399 - protein, 70 aa, Homo sapiens
VDNDSFYVEMIQDSTQRTADIPALFLLGRDGYMIRRSLEQHGLPWAIISIPVNVTSIPTFELLQPPWTFW

SEQ ID NO: 400 - protein, 187 aa, Homo sapiens [sequence omitted]

SEQ ID NO: 401 - protein, 194 aa, Homo sapiens
ERPPPRRTGTPVARPRGPPDPAVAAGTALRAKQFARYGAASGVVPGSLWPSPEQLRELEAEEREWYPSLATMQESLRVKQLAEEQKRREREQHIAECMAKMPQMIVNWQQQQRENWEKAQADKERRARLQAEAQELLGYQVDPRSARFQELLQDLEKKERNPQGGKTETEEGGATAALAAAVAQDPAASGAPSS

SEQ ID NO: 402 - protein, 124 aa, Homo sapiens
MQESLRVKQLAEEQKRREREQHIAECMAKMPQMIVNWQQQQRENWEKAQADKERRARLQAEAQELLGYQVDPRSARFQELLQDLEKKERKRLKEEKQKRKKEARAAALAAAVAQDPAASGAPSS

SEQ ID NO: 403 - protein, 113 aa, Homo sapiens
YQSLAETQQKKENFRPISLKNTDAKILNKILANQIQQHIKKLIHNDRVGFIPEMQGWFNICKSINIVHHINRTKDKNHMIISIDAEKAFDKIRQSFMLKTLNKLGIHGMYLGR

SEQ ID NO: 404 - protein, 101 aa, Homo sapiens
KKENFRPISLKNTDAKILNKILANQIQQHIKKLIHNDRVGFIPEMQGWFNICKSINIVHHINRTKDKNHMIISIDAEKAFDKIRQSFMLKTLNKLGIHGMY

SEQ ID NO: 405 - protein, 11 aa, Homo sapiens
DAKILNKILAN

SEQ ID NO: 406 - protein, 10 aa, Homo sapiens
IQQHIKKLIH

SEQ ID NO: 407 - protein, 19 aa, Homo sapiens
KDKNHMIISIDAEKAFDKI

SEQ ID NO: 408 - protein, 10 aa, Homo sapiens
MLKTLNKLGI

SEQ ID NO: 409 - protein, 10 aa, Homo sapiens
KKENFRPISL

SEQ ID NO: 410 - protein, 85 aa, Homo sapiens
WTMFIDLHMLNQPCISGMKPTRSLWISFLMCCWIWFANILLRIFASVFFRDIGLKFSFFCCVSARLWYQDDAGLINELGRIPSFY

SEQ ID NO: 411 - protein, 72 aa, Homo sapiens
ERPEEGTEPSPSPVAEQASVSMTPVFRAWGLWVYVLPTGFPGPCCMMLLELFPKESVPQAYQGILLYLHFGF

SEQ ID NO: 412 - protein, 123 aa, Homo sapiens
  SITE (23): Xaa equals any of the naturally occurring L-amino acids
  SITE (27): Xaa equals any of the naturally occurring L-amino acids
  SITE (32): Xaa equals any of the naturally occurring L-amino acids
  SITE (106): Xaa equals any of the naturally occurring L-amino acids
RGEVPHQPHPTRRTVVSGQAPWXPGPXALGQXVETAAGMGMPLVTVTAATFPTLSCPPRAWPEVEAPEAPALPVVPELPEVPMEMPLVLPPELELLSLEAVHRYQXGGTLMGWTRAEASANGS

SEQ ID NO: 413 - protein, 133 aa, Homo sapiens
MVLDPYRAVALELQANREPDFSSLVSPLSPRRMAARVFYLLLGECMHVCVCMWGRDTETRGPYRDSPDLPSPRLLTSALSATDSSRETRKAIWSPPDPAGAQIPLRLESIYKAARKPATSSKPRRASLKKKKK

SEQ ID NO: 414 - protein, 11 aa, Homo sapiens
AFRNLPNLRIL

SEQ ID NO: 415 - protein, 13 aa, Homo sapiens
AFQGLFHLFELRL

SEQ ID NO: 416 - protein, 206 aa, Homo sapiens
  SITE (3): Xaa equals any of the naturally occurring L-amino acids
NKXILEVPSARTTRIMGDHLDLLLGVVLMAGPVFGIPSCSFDGRIAFYRFCNLTQVPQVLNTTERLLLSFNYIRTVTASSFPFLEQLQLLELGSQYTPLTIDKEAFRNLPNLRILDLGSSKIYFLHPDAFQGLFHLFELRLYFCGLSDAVLKDGYFRNLKALTRLDLSKNQIRSLYLHPSFGKLNSLKSIDFSSNQIFLVCEHELE

SEQ ID NO: 417 - protein, 261 aa, Homo sapiens [sequence omitted]

SEQ ID NO: 418 - protein, 17 aa, Homo sapiens
LACCWLWSLSSHRSLQV

SEQ ID NO: 419 - protein, 59 aa, Homo sapiens
EIGSHSVAQAGLELPGSSDPPTSGSQSAGITGVSQGTQPSVDLCQEEPAGADQPHGSLQ

SEQ ID NO: 420 - protein, 67 aa, Homo sapiens; identical to SEQ ID NO: 243

SEQ ID NO: 421 - protein, 90 aa, Homo sapiens [sequence omitted]

SEQ ID NO: 422 - protein, 18 aa, Homo sapiens
FPGRTHASGNVKGKVILS

SEQ ID NO: 423 - protein, 106 aa, Homo sapiens
ADQEKIRNVKGKVILSMLVVSTVIIVFWEFINSTEGSFLWIYHSKNPEVDDSSAQKGWWFLSWFNNGIHNYQQGEEDIDKEKGREETKGRKMTQQSFGYGTGLIQT

SEQ ID NO: 424 - protein, 236 aa, Homo sapiens
  SITE (50): Xaa equals any of the naturally occurring L-amino acids
MQSPLVECPPPSIHYWPSVPAGAQGACSPMFHAAGWSRSQPNGEIPASSXGHLSIQRAALVVLENYYKDFTIYNPNLLTASKFRAAKHMAGLKVYNVDGPSNNATGQSRAMIAAAARRRDSSHNELYYEEAEHERRVKKRKARLVVAVEEAFIHIQRLQAEEQQKAPGEVMDPREAAQAIFPSMARALQKYLRITRQQNYHSMESILQAPGLLHHQRHDPQGLPRTVPQCGPHPAI

SEQ ID NO: 425 - protein, 23 aa, Homo sapiens
LSIQRAALVVLENYYKDFTIYNP

SEQ ID NO: 426 - protein, 15 aa, Homo sapiens
DSSHNELYYEEAEHE

SEQ ID NO: 427 - protein, 18 aa, Homo sapiens
FPSMARALQKYLRITRQQ

SEQ ID NO: 428 - protein, 140 aa, Homo sapiens; identical to SEQ ID NO: 245
  SITE (117): Xaa equals any of the naturally occurring L-amino acids

SEQ ID NO: 429 - protein, 49 aa, Homo sapiens
MQSPLWMPSSSSITWPSSCWSSGSCSPCSRCRWSRSTDGESRFYSLGHL

SEQ ID NO: 430 - protein, 303 aa, Homo sapiens
MQSPLWMPSSSSITWPSSCWSSGSCSPCSRCRWSRSTDGESRFYSLGHLSIQRAALVVLENYYKDFTIYNPNLLTASKFRAAKHMAGLKVYNVDGPSNNATGQSRAMIAAAARRRDSSHNELYYEEAEHERRVKKRKARLVVAVEEAFIHIQRLQAEEQQKAPGEVMDPREAAQAIFPSMARALQKYLRITRQQNYHSMESILQHLAFCITNGMTPKAFLERYLSAGPTLQYDKDRWLSTQWRLVSDEALTNGLRDGIVFVLKCLDFSLVVNVKKIPFIILSEEFIDPKSHKFVLRLQSETSV

SEQ ID NO: 431 - protein, 92 aa, Homo sapiens
MPRVFVFRALLLVLIFLFVVSYWLFYGVRILDSRDRNYQGIVQYAVSLVDALLFIHYLAIVLLELRQLQPMFTLQVVRSTDGESRFYSLGHL

SEQ ID NO: 432 - protein, 114 aa, Homo sapiens
MAFKLLILLIGTWALFFRKRRADMPRVFVFRALLLVLIFLFVVSYWLFYGVRILDSRDRNYQGIVQYAVSLVDALLFIHYLAIVLLELRQLQPMFTLQVVRSTDGESRFYSLGH

SEQ ID NO: 433 - protein, 37 aa, Homo sapiens; identical to SEQ ID NO: 246

SEQ ID NO: 434 - protein, 20 aa, Homo sapiens
IYGKTGQPDKIYVELHQNSP

SEQ ID NO: 435 - protein, 16 aa, Homo sapiens
FLEPLSGLYTCTLSYK

SEQ ID NO: 436 - protein, 16 aa, Homo sapiens
LQVVRLDSCRPGFGKN

SEQ ID NO: 437 - protein, 12 aa, Homo sapiens
CVSVLTYGAKSC

SEQ ID NO: 438 - protein, 26 aa, Homo sapiens
KNNWWQGVVVLACNPSTLGDRGSWIT

SEQ ID NO: 439 - protein, 17 aa, Homo sapiens
GQEFETRLTNIVKLRLY

SEQ ID NO: 440 - protein, 24 aa, Homo sapiens
SCLGLPKCWDYRQEPPHPATSYFL

SEQ ID NO: 441 - protein, 308 aa, Homo sapiens
PAKGEGCRRLHDHPHIWRLLWAHSDPDPLPTQPRAEQGETEFCVPVGPLCHDWHPLPVDVLAQLQLSHILPWGQPAPSRHQHLLLLGSLRAYLGGNIQCPAKKGKLDMVHIQNATLAGGVAVGTAAEMMLMPYGALIIGFVCGIISTLGFVYLTPFLESRLHIQDTCGINNLHGIPGIIGGIVGAVTAASASLEVYGKEGLVHSFDFQGFNGDWTARTQGKFQIYGLLVTLAMALMGGIIVGLILRLPFWGQPSDENCFEDAVYWEMPEGNSTVYIPEDPTFKPSGPSVPSVPMVSPLPMASSVPLVP

SEQ ID NO: 442 - protein, 145 aa, Homo sapiens
MTFFQVTLFAVNEFILLNLLKVKDAGGSMTIHTFGAYFGLTVTRILYRRNLEQSKERQNSVYQSDLFAMIGTLFLWMYWPSFNSAISYHGDSQHRAAINTYCSLAACVLTSVAISSALHKKGKLDMVHIQNATLAGGVAVGTAAE

SEQ ID NO: 443 - protein, 108 aa, Homo sapiens [sequence omitted]

SEQ ID NO: 444 - protein, 84 aa, Homo sapiens
MCVYIYVYTCMCVYIYVYICICVYIHVYTCICVYIHVYTCVCVYIYVYTCMCVYICIYVYIYICVCVSVYIYNRIIYILLALSL

SEQ ID NO: 445 - protein, 16 aa, Homo sapiens
HASAWNLILLTVFTLS

SEQ ID NO: 446 - protein, 24 aa, Homo sapiens
VYAALGAGVFTLFLALDTQLLMGN

SEQ ID NO: 447 - protein, 18 aa, Homo sapiens
EEYIFGALNIYLDIIYIF

SEQ ID NO: 448 - protein, 26 aa, Homo sapiens
WNLILLTVFTLSMAYLTGMLSSYYNT

SEQ ID NO: 449 - protein, 138 aa, Homo sapiens; identical to SEQ ID NO: 248

SEQ ID NO: 450 - protein, 11 aa, Homo sapiens
TLSLLVSLHTV

SEQ ID NO: 451 - protein, 241 aa, Homo sapiens
MSSSGTSDASPSGSPVLASYKPAPPKDKLPETPRRRMKKSLSAPLHPEFEEVYRFGAESRKLLLREPVDAMPDPTPFLLARESAEVHLIKERPLVIPPIASDRSGEQHSPAREKPHKAHVGVAHRIHHATPPQPARGEDPGGRPGERRQGGEEALRDGQNCVKPAVPHPALSMHCEHHWEISATPFLFNPMHAKHFSHLPTHSPSASLALFFTPKYDRVPAAEYVFPNCCGQTPVCRIACF

SEQ ID NO: 452 - protein, 85 aa, Homo sapiens
MSSSGTSDASPSGSPVLASYKPAPPKDKLPETPRRRMKKSLSAPLHPEFEEVYRFGAESRKLLLREPVDAMPDPTPFLLARESAE

SEQ ID NO: 453 - protein, 63 aa, Homo sapiens
VHLIKERPLVIPPIASDRSGEQHSPAREKPHKAHVGVAHRIHHATPPQPARGEDPGGRPGERR

SEQ ID NO: 454 - protein, 93 aa, Homo sapiens
QGGEEALRDGQNCVKPAVPHPALSMHCEHHWEISATPFLFNPMHAKHFSHLPTHSPSASLALFFTPKYDRVPAAEYVFPNCCGQTPVCRIACF

SEQ ID NO: 455 - protein, 59 aa, Homo sapiens
KRASQPPCTRNLKRSTDSGQRAGNSFCGNQWMLCPTPPHFCWLGSPPRSTSSKRGPSSS

SEQ ID NO: 456 - protein, 65 aa, Homo sapiens
PPSPPTEAASSTARPAKSRTRPTSGWHIGSTTPPRRSQPEVKTLAVDQVNGGKVVRKHSGTDRTV

SEQ ID NO: 457 - protein, 148 aa, Homo sapiens
MWNPNAGQPGPNPYPPNIGCPGGSNPAHPPPINPPFPPGPCPPPPGAPHGNPAFPPGGPPHPVPQPGYPGCQPLGPYPPPYPPPAPGIPPVNPLAPGMVGPAVIVDKKMQKKMKKAHKKMHKHQKHHKYHKHGKHSSSSSSSSSSDSD

SEQ ID NO: 458 - protein, 58 aa, Homo sapiens [sequence omitted]

SEQ ID NO: 459 - protein, 84 aa, Homo sapiens
STLSPRPLSSSPRSSPWQSSFPPRWAPSSCATARVSRMPTVGSLPSSIPTACPWNPSCESLGSWHGWTSSDSRQEDAEENEESS

SEQ ID NO: 460 - protein, 86 aa, Homo sapiens [sequence omitted]

SEQ ID NO: 461 - protein, 65 aa, Homo sapiens
  SITE (56): Xaa equals any of the naturally occurring L-amino acids
MASIPPLPPPLPAVILTEYRPWTLPSSLTSSALPSSFRCHVVLGECSPCAPHPLPXPEPHPAVEP

SEQ ID NO: 462 - protein, 147 aa, Homo sapiens
PRHTYWGIWLVPAAMASPHSHPAQGVLQPPGPQPRWEDRVALGTRGRSPGAYLTESAPQQASTTPGPPTCHGKVGSEWAWLGAAPGPLPTHPSHYAIRVPSNICSCPGASSAPALRGVVRQPPGPQNPRQGGRRGTRASPVGSLFCV

SEQ ID NO: 463 - protein, 105 aa, Homo sapiens
MFAVLPAVEGRATPHQDRTCYPSRSRPWPSQPSPRGSMPVPRPGAARGQLDGHVQGQGWALQWGGPPAPAVYRRMALPPRAAGSYLDRKCPHPLPGARLCPGLPL

SEQ ID NO: 464 - protein, 127 aa, Homo sapiens
VFGAVFLTTPSHDLATPTGASGWCLLPWPAPTLTLHRGSCSPQAHSLVGRTGWPWGQEGGAQGLTSLRVLPSRHPLPQGPPHVMARLVVNGPGWEQPLAHCPPTHLTMQFEFQATFAPALGPALPQP

SEQ ID NO: 465 - protein, 186 aa, Homo sapiens [sequence omitted]

SEQ ID NO: 466 - protein, 100 aa, Homo sapiens
MATCRVKAGPCSGAGRQPQQFTDAWLFLPEQPAATWTGNVLIPSLGPGSALAFLCEPLLSLCCLGTPDRGVRVCPSVTFYSPRVEERKRGKSKGVQTPPQ

SEQ ID NO: 467 - protein, 244 aa, Homo sapiens
MKWFSTQPLWLNTKQRSHRRGPGPPPAPLSGVLGSRGLPHHPSQGWGRAGPRAGANVAWNSNCIVRWVGGQWARGCSQPGPFTTNLAMTCGGPWGSGCLLGSTLSEVSPWAPPSCPQGHPVLPTRLWAWGLQDPLCRVRVGAGHGSRHQPDAPVGVARSWDGVVRNTAPKTQNKNTTNGRRSPPPTEVGFEPLLIFPVSFLQPLVSRKSQTGTHAHHGQESRDSTKKGGVHRGRPGQSLAPGRG

SEQ ID NO: 468 - protein, 165 aa, Homo sapiens [sequence omitted]

SEQ ID NO: 469 - protein, 128 aa, Homo sapiens
MRTFPVQVAAGCSGRKSHASVNCWGWRPAPLQGPALTLHVAIQLPSGCPWPWHRHRASRAGLAGPGPGPGGVARPILMWGGSALHGGKHSKHRTLKPKAPLGSLAPTSWGGDRRHRDLSPKPAGGSSC

SEQ ID NO: 470 - protein, 13 aa, Homo sapiens
GLMECLIHRHGSH

SEQ ID NO: 471 - protein, 17 aa, Homo sapiens
STKGMQFILTGITLSGY

SEQ ID NO: 472 - protein, 209 aa, Homo sapiens
PRVRALLFARSLRLCRWGAKRLGVASTEAQRGVSFKLEEKTAHSSLALFRDDTGVKYGLVGLEPTKVALNVERFREWAVVLADTAVTSGRHYWEVTVKRSQQFRIGVADVDMSRDSCIGVDDRSWVFTMPSASGTPCWPTRKPQLRVLGSQEVGLLLEYEAQKLSLVDVSQVSVVHTLQTDFRGPVVPAFALWDGELLTHSGLEVPEGL

SEQ ID NO: 473 - protein, 98 aa, Homo sapiens
MSRDSCIGVDDRSWVFTMPSASGTPCWPTRKPQLRVLGSQEVGLLLEYEAQKLSLVDVSQVSVVHTLQTDFRGPVVPAFALWDGELLTHSGLEVPEGL

SEQ ID NO: 474 - DNA, 1913 bp, Homo sapiens
gcacgagcggcacgagcggatcctcacacgactgtgatccgattctttccagcggcttctgcaaccaagcgggtcttacccccggtcctccgcgtctccagtcctcgcacctggaaccccaacgtccccgagagtccccgaatccccgctcccaggctacctaagaggatgagcggtgctccgacggccggggcagccctgatgctctgcgccgccaccgccgtgctactgagcgctcagggcggacccgtgcagtccaagtcgccgcgctttgcgtcctgggacgagatgaatgtcctggcgcacggactcctgcagctcggccaggggctgcgcgaacacgcggagcgcacccgcagtcagctgagcgcgctggagcggcgcctgagcgcgtgcgggtccgcctgtcagggaaccgaggggtccaccgacctcccgttagcccctgagagccgggtggaccctgaggtccttcacagcctgcagacacaactcaaggctcagaacagcaggatccagcaactcttccacaaggtggcccagcagcagcggcacctggagaagcagcacctgcgaattcagcatctgcaaagccagtttggcctcctggaccacaagcacctagaccatgaggtggccaagcctgcccgaagaaagaggctgcccgagatggcccagccagttgacccggctcacaatgtcagccgcctgcaccggctgcccagggattgccaggagctgttccaggttggggagaggcagagtggactatttgaaatccagcctcaggggtctccgccatttttggtgaactgcaagatgacctcagatggaggctggacagtaattcagaggcgccacgatggctcagtggacttcaaccggccctgggaagcctacaaggcggggtttggggatccccacggcgagttctggctgggtctggagaaggtgcatagcatcacgggggaccgcaacagccgcctggccgtgcagctgcgggactgggatggcaacgccgagttgctgcagttctccgtgcacctgggtggcgaggacacggcctatagcctgcagctcactgcacccgtggccggccagctgggcgccaccaccgtcccacccagcggcctctccgtacccttctccacttgggaccaggatcacgacctccgcagggacaagaactgcgccaagagcctctctggaggctggtggtttggcacctgcagccattccaacctcaacggccagtacttccgctccatcccacagcagcggcagaagcttaagaagggaatcttctggaagacctggcggggccgctactacccgctgcaggccaccaccatgttgatccagcccatggcagcagaggcagcctcctagcgtcctggctgggcctggtcccaggcccacgaaagacggtgactcttggctctgcccgaggatgtggccgttccctgcctgggcaggggctccaaggaggggccatctggaaacttgtggacagagaagaagaccacgactggagaagccccctttctgagtgcaggggggctgcatgcgttgcctcctgagatcgaggctgcaggatatgctcagactctagaggcgtggaccaaggggcatggagcttcactccttgctggccagggagttggggactcagagggaccacttggggccagccagactggcctcaatggcggactcagtcacattgactgacggggaccagggcttgtgtgggtcgagagcgccctcatggtgctggtgctgttgtgtgtaggtcccctggggacacaagcaggcgccaatggtatctgggcggagctcacagagttcttggaataaaagcaacctcagaacaaaaaaaaaaaaaaaaaaaaaaaaaaaaaaaaaaaaaaaaa

SEQ ID NO: 475 - DNA, 1221 bp, Homo sapiens
atgagcggtgctccgacggccggggcagccctgatgctctgcgccgccaccgccgtgctactgagcgctcagggcggacccgtgcagtccaagtcgccgcgctttgcgtcctgggacgagatgaatgtcctggcgcacggactcctgcagctcggccaggggctgcgcgaacacgcggagcgcacccgcagtcagctgagcgcgctggagcggcgcctgagcgcgtgcgggtccgcctgtcagggaaccgaggggtccaccgacctcccgttagcccctgagagccgggtggaccctgaggtccttcacagcctgcagacacaactcaaggctcagaacagcaggatccagcaactcttccacaaggtggcccagcagcagcggcacctggagaagcagcacctgcgaattcagcatctgcaaagccagtttggcctcctggaccacaagcacctagaccatgaggtggccaagcctgcccgaagaaagaggctgcccgagatggcccagccagttgacccggctcacaatgtcagccgcctgcaccggctgcccagggattgccaggagctgttccaggttggggagaggcagagtggactatttgaaatccagcctcaggggtctccgccatttttggtgaactgcaagatgacctcagatggaggctggacagtaattcagaggcgccacgatggctcagtggacttcaaccggccctgggaagcctacaaggcggggtttggggatccccacggcgagttctggctgggtctggagaaggtgcatagcatcacgggggaccgcaacagccgcctggccgtgcagctgcgggactgggatggcaacgccgagttgctgcagttctccgtgcacctgggtggcgaggacacggcctatagcctgcagctcactgcacccgtggccggccagctgggcgccaccaccgtcccacccagcggcctctccgtacccttctccacttgggaccaggatcacgacctccgcagggacaagaactgcgccaagagcctctctggaggctggtggtttggcacctgcagccattccaacctcaacggccagtacttccgctccatcccacagcagcggcagaagcttaagaagggaatcttctggaagacctggcggggccgctactacccgctgcaggccaccaccatgttgatccagcccatggcagcagaggcagcctcctag

SEQ ID NO: 476 - protein, 175 aa, Homo sapiens [sequence omitted]

SEQ ID NO: 477 - protein, 13 aa, Homo sapiens
WWFGTCSHSNLNG

SEQ ID NO: 478 - protein, 19 aa, Homo sapiens
SGGWWFGTCSHSNLNGQYF

SEQ ID NO: 479 - protein, 32 aa, Homo sapiens
GHDLPQDAWLRWVLAGALCAGGWAVNYLPFFL

SEQ ID NO: 480 - protein, 18 aa, Homo sapiens
FLYHYLPALTFQILLLPV

SEQ ID NO: 481 - protein, 59 aa, Homo sapiens
  SITE (44): Xaa equals any of the naturally occurring L-amino acids
  SITE (49): Xaa equals any of the naturally occurring L-amino acids
MSPLPWPGPLPGGRQGHRLEPCCSSGCAGGPTWPHCSSQSWPMXSARHXGLGHCCPSSP

SEQ ID NO: 482 - protein, 32 aa, Homo sapiens
DICRLERAVCRDEPSALARALTWRQARAQAGA

SEQ ID NO: 483 - protein, 114 aa, Homo sapiens
  SITE (1): Xaa equals any of the naturally occurring L-amino acids
  SITE (6): Xaa equals any of the naturally occurring L-amino acids
XAPATXAWDTVVPPLPRKCQCSGSARSHGAGRSALHSPLEGSRPKVPAGAVGKSLPGQSRPQHCLPPKQPKQCRPGLELKEGPLLTPTRASVQLSHPACLYWAPLLWIRDPASV

SEQ ID NO: 484 - protein, 55 aa, Homo sapiens
  SITE (1): Xaa equals any of the naturally occurring L-amino acids
  SITE (6): Xaa equals any of the naturally occurring L-amino acids
XAPATXAWDTVVPPLPRKCQCSGSARSHGAGRSALHSPLEGSRPKVPAGAVGKSL

SEQ ID NO: 485 - protein, 59 aa, Homo sapiens
PGQSRPQHCLPPKQPKQCRPGLELKEGPLLTPTRASVQLSHPACLYWAPLLWIRDPASV

SEQ ID NO: 486 - protein, 133 aa, Homo sapiens
  SITE (55): Xaa equals any of the naturally occurring L-amino acids
  SITE (61): Xaa equals any of the naturally occurring L-amino acids
DICRLERAVCRDEPSALARALTWRQARAQAGAMLLFGLCWGPYVATLLLSVLAYXQRPPLXPGTLLSLLSLGSASAAAVPVAMGLGDQRYTAPWRAAAQRCLQGLWGRASRDSPGPSIAYHPSSQSSVDLDLN

SEQ ID NO: 487 - protein, 48 aa, Homo sapiens
  SITE (34): Xaa equals any of the naturally occurring L-amino acids
  SITE (43): Xaa equals any of the naturally occurring L-amino acids
MERVGMESGEMVCGLGSACNNPSDLGQVPVPLWXSVSPPVFGXGWNGH

SEQ ID NO: 488 - protein, 107 aa, Homo sapiens
  SITE (84): Xaa equals any of the naturally occurring L-amino acids
MRSFQDVSALEEWRGGKDLEPTHSLLLLLPLRDLLVVLGEIRKRQMEGCVWKGWGWNPEKWFAVLALPVTTRVTLGKSLSLSGXQFLHLYLERVGMGTEVLSSSDLL

SEQ ID NO: 489 - protein, 118 aa, Homo sapiens
  SITE (62): Xaa equals any of the naturally occurring L-amino acids
  SITE (70): Xaa equals any of the naturally occurring L-amino acids
MHPAGPTFMGSKPIREQQFGPDACLLLLCVAMAGTEASRAAQQCTSQKVRAGQDFSAHSNPXQIQVEKLXPREGQGLAQGHSGCYRQSQDRKPFLRIPSPPFPYTTLHLPFPDFAKNH

SEQ ID NO: 490 - protein, 61 aa, Homo sapiens
MHPAGPTFMGSKPIREQQFGPDACLLLLCVAMAGTEASRAAQQCTSQKVRAGQDFSAHSNP

SEQ ID NO: 491 - protein, 48 aa, Homo sapiens
PREGQGLAQGHSGCYRQSQDRKPFLRIPSPPFPYTTLHLPFPDFAKNH

SEQ ID NO: 492 - protein, 22 aa, Homo sapiens
DPRVRKPPTATLTTARTRPTTD

SEQ ID NO: 493 - protein, 82 aa, Homo sapiens
  SITE (70): Xaa equals any of the naturally occurring L-amino acids
  SITE (81): Xaa equals any of the naturally occurring L-amino acids
  SITE (82): Xaa equals any of the naturally occurring L-amino acids
AALEASVPAIATQRSSRQASGPNCCSLMGLDPMKVGPAGCISWDSVEADQVAGASGGRIEVKGCGMENLXRLHLGSGKGQXX

SEQ ID NO: 494 - protein, 99 aa, Homo sapiens
MLHRQWLTVRRAGGPPRTDQQRRTVRCLRDTVLLLHGLSQKDKLFMMHCVEVLHQFDQVMPGVSMLIRGLPDVTDCEEAALDDLCAAETDVEDPEVECG

SEQ ID NO: 495 - protein, 62 aa, Homo sapiens
  SITE (2): Xaa equals any of the naturally occurring L-amino acids
  SITE (58): Xaa equals any of the naturally occurring L-amino acids
GXANPEDSVCILEGFSVTALSILQHLVCHSGAVRLPITVRSGGRFCCWGRKQEPGSQXSDGD

SEQ ID NO: 496 - protein, 65 aa, Homo sapiens [sequence omitted]

SEQ ID NO: 497 - protein, 220 aa, Homo sapiens
PKTLPVISCPGSSVCSKCCQSASAQRHPCLACCWLLSSSPCWRTTTSWHLSSVPTQKAASCCCCTCTSHHGLTEWPWRHNGSSWNKRWCGSWLSLVCKSPLPPVTGSNCQCNVEVVRALTVMLHRQWLTVRRAGGPPRTDQQRRTVRCLRDTVLLLHGLSQKDKLFMMHCVEVLHQFDQVMPGVSMLIRGLPDVTDCEEAALDDLCAAETDVEDPEVECG

SEQ ID NO: 498 - protein, 223 aa, Homo sapiens
  SITE (2): Xaa equals any of the naturally occurring L-amino acids
  SITE (58): Xaa equals any of the naturally occurring L-amino acids
GXANPEDSVCILEGFSVTALSILQHLVCHSGAVRLPITVRSGGRFCCWGRKQEPGSQXSDGDMTSALRGVADDQGQHPLLKMLLHLLAFSSAATGHLQASVLTQCLKVLVKLAENTSCDFLPRFQCVFQVLPKCLSPETPLPSVLLAVELLSLLADHDQLAPQLCSHSEGCLLLLLYMYITSRPDRVALETQWLQLEQEVVWLLAKLGVQEPLAPSHWLQLPV

SEQ ID NO: 499 - protein, 123 aa, Homo sapiens
QSPLPPVTGSNCQCNVEVVRALTVMLHRQWLTVRRAGGPPRTDQQRRTVRCLRDTVLLLHGLSQKDKLFMMHCVEVLHQFDQVMPGVSMLIRGLPDVTDCEEAALDDLCAAETDVEDPEVECG

SEQ ID NO: 500 - protein, 63 aa, Homo sapiens
QSPLPPVTGSNCQCNVEVVRALTVMLHRQWLTVRRAGGPPRTDQQRRTVRCLRDTVLLLHGLS

SEQ ID NO: 501 - protein, 60 aa, Homo sapiens
QKDKLFMMHCVEVLHQFDQVMPGVSMLIRGLPDVTDCEEAALDDLCAAETDVEDPEVECG

SEQ ID NO: 502 - protein, 50 aa, Homo sapiens
CLRDTVLLLHGLSQKDKLFMMHCVEVLHQFDQVMPGVSMLIRGLPDVTDC

SEQ ID NO: 503 - protein, 102 aa, Homo sapiens
MSGQLDARPAAALHPQGLAHPLWTCLLPRKGPSEVPQRPPQLWVVSISVLQGQHRGRAGPRDEQSVDVTNTTFLLMAASIYLHDQNPDAALRALHQGDSLEW

SEQ ID NO: 504 - protein, 20 aa, Homo sapiens
SVDVTNTTFLLMAASIYLHD

SEQ ID NO: 505 - protein, 17 aa, Homo sapiens
QNPDAALRALHQGDSLE

SEQ ID NO: 506 - protein, 14 aa, Homo sapiens
RDSIVAELDREMSR

SEQ ID NO: 507 - protein, 39 aa, Homo sapiens; identical to SEQ ID NO: 251

SEQ ID NO: 508 - protein, 11 aa, Homo sapiens
HGFPEFWYSWR

SEQ ID NO: 509 - protein, 10 aa, Homo sapiens
ASHWLQQDQP

SEQ ID NO: 510 - protein, 9 aa, Homo sapiens
PINHYRNIF

SEQ ID NO: 511 - protein, 9 aa, Homo sapiens
YPEMVMKLI

SEQ ID NO: 512 - protein, 14 aa, Homo sapiens
PEFWYSWRYQLREF

SEQ ID NO: 513 - protein, 9 aa, Homo sapiens
HDWGGMIAW

SEQ ID NO: 514 - protein, 31 aa, Homo sapiens
RLGAVLTPVIPALWEAEASRSPETRSLRPAW

SEQ ID NO: 515 - protein, 14 aa, Homo sapiens
GSLPPKPIYLVVPR

SEQ ID NO: 516 - protein, 16 aa, Homo sapiens
LVFAEHRYYGKSLPFG

SEQ ID NO: 517 - protein, 10 aa, Homo sapiens
EQALADFAEL

SEQ ID NO: 518 - protein, 18 aa, Homo sapiens
GGSYGGMLSAYLRMKYPH

SEQ ID NO: 519 - protein, 16 aa, Homo sapiens
NIIFSNGNLDPWAGGG

SEQ ID NO: 520 - protein, 22 aa, Homo sapiens
AMMDYPYPTDFLGPLPANPVKV

SEQ ID NO: 521 - protein, 8 aa, Homo sapiens
FYTGNEGD

SEQ ID NO: 522 - protein, 490 aa, Homo sapiens; identical to SEQ ID NO: 254

SEQ ID NO: 523 - protein, 22 aa, Homo sapiens
CSVFPPSLWFYLPLVFDDGDVQ

SEQ ID NO: 524 - protein, 122 aa, Homo sapiens
  SITE (46): Xaa equals any of the naturally occurring L-amino acids
  SITE (113): Xaa equals any of the naturally occurring L-amino acids
GVSLPLLGDASQLGYLGVRDALEEALCLFSDVQLCAGRTSALFKAXRQGRLSLQRILLPFVWLCPAPQRWSLQRQAGLLELRWAPPSSSFLAALFTPSSLGNGGRPSPSLTAXLQFDLRLLC

SEQ ID NO: 525 - protein, 74 aa, Homo sapiens
  SITE (62): Xaa equals any of the naturally occurring L-amino acids
  SITE (74): Xaa equals any of the naturally occurring L-amino acids
VCRGFCCLLFGCALPPRGGVYRGRQASLNCGGLHRVRVSWPLCLPPQASAMVGAPPPASLPXCSLISDCCASNX

SEQ ID NO: 526 - protein, 34 aa, Homo sapiens
MSHKHMRRSATSYIIRERQIKIIVRYHYTPIMTT

SEQ ID NO: 527 - protein, 16 aa, Homo sapiens
IRERQIKIIVRYHYTP

SEQ ID NO: 528 - protein, 13 aa, Homo sapiens
KKTCTMFIATLFT

SEQ ID NO: 529 - protein, 13 aa, Homo sapiens
EKIFAKHLSVKGL

SEQ ID NO: 530 - protein, 83 aa, Homo sapiens
  SITE (21): Xaa equals any of the naturally occurring L-amino acids
  SITE (39): Xaa equals any of the naturally occurring L-amino acids
SVASVFIPLKVSVTKQFIFFXFFFFLRRSLAPAWVAERXTSQETKQNKKTPQLRGKVAHACDPITLGGRRWEVGESLEARSPS

SEQ ID NO: 531 - protein, 184 aa, Homo sapiens
YMCCPFVLDKDGVSAAVISAELASFLATKNLSLSQQLKAIYVEYGYHITKASYFICHDQETIKKLFENLRNYDGKNNYPKACGKFEISAIRDLTTGYDDSQPDKKAVLPTSKSSQMITFTFANGGVATMRTSGTEPKIKYYAELCAPPGNSDPEQLKKELNELVSAIEEHFFQPQKYNLQPKAD

SEQ ID NO: 532 - protein, 199 aa, Homo sapiens
ARGKTVLFAFEEAIGYMCCPFVLDKDGVSAAVISAELASFLATKNLSLSQQLKAIYVEYGYHITKASYFICHDQETIKKLFENLRNYDGKNNYPKACGKFEISAIRDLTTGYDDSQPDKKAVLPTSKSSQMITFTFANGGVATMRTSGTEPKIKYYAELCAPPGNSDPEQLKKELNELVSAIEEHFFQPQKYNLQPKAD

SEQ ID NO: 533 - protein, 18 aa, Homo sapiens
DKDGVSAAVISAELASFL

SEQ ID NO: 534 - protein, 13 aa, Homo sapiens
RDLTTGYDDSQPD

SEQ ID NO: 535 - protein, 15 aa, Homo sapiens
KAVLPTSKSSQMITF

SEQ ID NO: 536 - protein, 17 aa, Homo sapiens
TMRTSGTEPKIKYYAEL

SEQ ID NO: 537 - protein, 22 aa, Homo sapiens
SQRIFLHGNRISHVPAASFRAC

SEQ ID NO: 538 - protein, 22 aa, Homo sapiens
LTILWLHSNVLARIDAAAFTGL

SEQ ID NO: 539 - protein, 23 aa, Homo sapiens
LEQLDLSDNAQLRSVDPATFHGL

SEQ ID NO: 540 - protein, 22 aa, Homo sapiens
LHTLHLDRCGLQELGPGLFRGL

SEQ ID NO: 541 - protein, 22 aa, Homo sapiens
LQYLYLQDNALQALPDDTFRDL

SEQ ID NO: 542 - protein, 22 aa, Homo sapiens
LTHLFLHGNRISSVPERAFRGL

SEQ ID NO: 543 - protein, 22 aa, Homo sapiens
LDRLLLHQNRVAHVHPHAFRDL

SEQ ID NO: 544 - protein, 22 aa, Homo sapiens
LMTLYLFANNLSALPTEALAPL

SEQ ID NO: 545 - protein, 13 aa, Homo sapiens
AHCSAARGLRATR

SEQ ID NO: 546 - protein, 15 aa, Homo sapiens [sequence omitted]

SEQ ID NO: 547 - protein, 23 aa, Homo sapiens
PSLTCSLTPLGLALVLWTVLGPC

SEQ ID NO: 548 - protein, 21 aa, Homo sapiens
LPSLTCSLTPLGLALVLWTVL

SEQ ID NO: 549 - protein, 24 aa, Homo sapiens
LPSLTCSLTPLGLALVLWTVLGPC

SEQ ID NO: 550 - protein, 14 aa, Homo sapiens
CRNLTILWLHSNVL

What is claimed is:

1. An isolated antibody or fragment thereof that binds specifically to an isolated HWHGU54 polypeptide selected from the group consisting of:
   (a) A polypeptide comprising amino acid residues 1 to 414 of SEQ ID NO:136;
   (b) A polypeptide comprising amino acid residues 2 to 414 of SEQ ID NO:136;
   (c) A polypeptide comprising amino acid residues 20 to 414 of SEQ ID NO: 136;
   (d) A HWHGU54 polypeptide comprising the amino acid sequence of the full-length polypeptide, which amino acid sequence is encoded by the cDNA clone contained in ATCC™ Deposit No:209782, which was deposited on Apr. 20, 1998;
   (e) A HWHGU54 polypeptide comprising the amino acid sequence of the full-length polypeptide, excluding the N-terminal methionine residue, which amino acid sequence is encoded by the cDNA clone contained in ATCC™ Deposit No:209782, which was deposited on Apr. 20, 1998; and
   (f) A HWHGU54 polypeptide comprising the amino acid sequence of the mature polypeptide, which amino acid sequence is encoded by the cDNA clone contained in ATCC™ Deposit No:209782, which was deposited on Apr. 20, 1998.

2. A recombinant host cell that expresses the isolated antibody or fragment thereof of claim 1.

3. A method of making the isolated antibody or fragment thereof comprising:
   (a) culturing the recombinant host cell of claim 2 under conditions such that said antibody or fragment thereof is expressed; and
   (b) recovering said antibody or fragment thereof.

4. The antibody or fragment thereof of claim 1 that specifically binds (a).

5. The antibody or fragment thereof of claim 1 that specifically binds (b).

6. The antibody or fragment thereof of claim 1 that specifically binds (c).

7. The antibody or fragment thereof of claim 1 that specifically binds (d).

8. The antibody or fragment thereof of claim 1 that specifically binds (e).

9. The antibody or fragment thereof of claim 1 that specifically binds (f).

10. The antibody or fragment thereof of claim 1 wherein said antibody or fragment thereof is polyclonal.

11. The antibody or fragment thereof of claim 1 wherein said antibody or fragment thereof is monoclonal.

12. The antibody or fragment thereof of claim 1 which is selected from the group consisting of:
   (a) a chimeric antibody or fragment thereof;
   (b) a humanized antibody or fragment thereof;
   (c) a single chain antibody; and
   (d) a Fab fragment.

13. A hybridoma that produces the antibody or fragment thereof of claim 1.

14. An isolated antibody or fragment thereof that specifically binds a HWHGU54 polypeptide purified from a cell culture wherein said HWHGU54 polypeptide consists of amino acid residues 1 to 414 of SEQ ID NO:136.

15. The antibody or fragment thereof of claim 14 wherein said antibody or fragment thereof is monoclonal.

16. The antibody or fragment thereof of claim 14 wherein said antibody or fragment thereof is polyclonal.

17. The antibody or fragment thereof of claim 14 which is selected from the group consisting of:
   (a) a chimeric antibody or fragment thereof;
   (b) a humanized antibody or fragment thereof;
   (c) a single chain antibody; and
   (d) a Fab fragment.

* * * * *